United States Patent 10,407,724 (METHODS AND COMPOSITIONS FOR SCREENING AND TREATING DEVELOPMENTAL DISORDERS) - sequence listing, part 68

SEQ ID NO: 1861 - DNA, 2220383 bp, Homo sapiens
tgtaacataactgcgtgctttattgagatacacagtaaagcagtactataatacaatagtaaggcatatatttggtgaagtctgatatgttgtgaaaatgcagtaaaactgaagtttaaaaaaataattcgtaaatgttacagtgttggtgttaaaacacaatatattatgatactcaagtaagaactcagtacctgaaaacaatgacaaaacatgccatgtgatgtttatgcttcagttacattatgatttacagtttaatacttggtggttataaagaacacaacacgaaataatgtccaaattaattatgcttaaaatgcagcaataaagctctcaatttttgttcaaatattatgacagactcactccagagctaatgtgtctaaaagaaaaacaaaaagattaaaacaaaattatttatgcactctatttacctctgattttagaatgaaacttacttacttaaacttcttagtaggatgtaaagtaaccccttgttttaaatctgagttttaaaaatccttgggtaaagaaaaggtccagcgtcacataaaggaaaaaaatgcaagacaaaaaccaaatcttcatgtaatttggtaatttgttaccttagagctttgggttttcttttgaaaattatgaaggaaaaagaaagaattataaaggaaaaagaaaataacgcaatggacaagtggtgaagctgtgaactcaggtgtgcacaattatcaggaacaccccaaaaccaaagtgaggtagaaatagcatgagaagccgtgtttgatgttaattaattaattattaataatggacaaaacccactctccaaaagctaattacacttgatgtcagcccactctccaaaagctaattacacttgatgtcagaggtaacagatttgcaaaattataggtcacacggtggtatctattgaatgaatgatttaaaaatcaaaaagaaataaaatggcatgaaagagtaaagctttttcctaccagtccttagcttttcctcttgagcttttctcctcttttttgagcaatttttgtttgtttgtttatatatttaacctgtctaatccaccaagaagggtttttttgtaacatttgaatcaatttgccttctttcttacttacttacaaacctgtgtggaactactcgcagagaaatgcaaaggatggaaacacagttcatgggcttctgggttgatacctgtcagtatcacaaatgtgatggggctactgttttacaccttttcccaaagtttatttattttaaattatgtcttgtggcatttaaaaactcatcccacatgggacaataaatctaaaaaagcaacaaaaaccaaaccacccagttccttttgactgtgagaagagggcataataatttagttgtaattacagagaactttatgtattatgaacaatcatccaatccttcacttaaagagtggcctactccttcacagggatgggctgggaatccatagccctccagccctatcatcgtcctgctactgcttgggagttaaaaaataccttctgatgttcacaaggtcagaataccttctgattgatttccactgaagcatcattaaatctaaatcgtggcattgctagcagcaggaagctgaatgtatcaatcaatcaatcaatcaaccaaccaaccgattactcactctgatataataagtcctgtgtattcattcacatgttccctttaaaaaaatccaatactttactttactttcgttgtcagtggaaagttgtttaaaatgagaaacatctggagctgtagacaatgttttagtgtggtgtagtttcctcctggcttccggctccgggaaaaatccattctagaccaagcaggtaagcctggatgactgactagaagtaatttctttctattaggatgtgacatgaacatttaaaaaatggaaaaagtcagtctatagaaattcgtatctctttatctatataactatagtatttatatacttatagacatatagatatatgaaatgaaaactcaagcctgccccactcagctgacagttctcaaatgagcagtgtgtagtagtcatttggtgtggtggtagaggaagtcttatctttaatatgcaaaaaaagaaaaagccatgaatttcatatggatatcacgccaaaaggatgcaaaacaatgcgctgcctcaaagttttgtgtgtgtgtgtgtatgtgtgtgtgtgtgtgtttgttttgtttttaggggtttttataaacaacttttttttataaagcacactttagtttacaatctttctttataactgttataaatttttaaacaacccaaaatgcgttccatataaagaaatggcaagttatttagctatcaagattttacatgtagttttcttataacttttttgtacaattgcatagacgtgtaaaacctgccattgttaacaaaacaataacagacttagaaactactgaaatctacagtataataccactacccttcacaaaaatatagatttatttcttgtaaactcttactgtctaatcctctttgttgtatgaatattataaaaaccatgcgggaatcaggagttgtaaaacatttattctgctccttcttcatctgtcatgactgatactaaggactccatcgctctgcccaaatcatctgccatgtggaaaagacttcctacattgtgtcctggaaaacaaagagaaagaaagacagactttacaaaaggtgcagatagatagcatcactctgtttctttgccatttgggaaatcattccccatttctgggtgaagacaacacagaagctgcatcgagggtgtacacaacaaggtttgatttttcaccagtttccaggaagaagcaaagccttattaatgaagccattacacgttgtttgttagtatcagcttaatgttggatcaggctactggtgtttacatggaaaaatgtcaagctacattcaggttcccaatgtaaatatatatcaaaagaattccatagataagcacaagatttctatcagaacaggaatattccatgatgggatacatcttttccaccttggctatgagtgattgattgattacttactctctacttgtattaacgaacattttttttactatcaatcaaaccaccatcaccaccttcacaactaccactaccatcaccagcacccaaccatcgtcaccattatcactgccaccatcaccgccacaccaacttttcatttcaaagctgtttcaggctgttggcttgcttctgaggctatggtggaggtggctattttctctctgcttttacttgggttgaaaaataataataataaactcttgaattgaccttttggtgcactattaacatttgaattaggaaacctcagaataaaaattgctttacattccaaattactctagaccctaattataaggtgacccacatgtattgtatgcatttgggtattttgtgaatccatcttagagctcctcctaaatgagggttaactatcacaatagccttttactaataatgcagcacgacctagcacgaatctcccagcacggagaaaaagaacagcacaatgtccctgggtacttcgtagcaaaattcagatttagagtaagataatctgagacttactttatggcttgccttttcgtctatgtcccatagttttacatggctaattttaattattgcacattggtaaatccttccactattcaagtattgtctttggaactgaaatgctttactaggctattactaccttgccatgtatcaactttacagattcccataataattgttaaaaataccaataaaaattaaagatatcccaataaaaattaaagctatagactagggagagtattttgttttaatatttatttcaagagatatagcttctctacaaaatgaagcggattcacgggcaggcacttaaacagtgatggcaccagatcaactgaagacttacttattaaaagtttaatgtcattcaggcatttctattaaggtgaccaagtttgtatatctatctttttgtgctttattagtgcaaagaatttcatggagtattaattatattttagaaaatcactttggattttggctgagactgcaagtataaaaattttttaacaaagcatatgcaactattcataaagtgggccaatagtttggcagccctcagtgaagaactgaaatcatttttggctttctgtgccataaaaaccacaggaagacgacacagtggggcctttgctgctccttagagctcagagtacaaatatataactgctgctatcaagttggagggcttcccctgtatctatttttggctgtccagcaaccctgggaaatctgcataattattcatgcataaattgaagatagatggactaactgccaatttttaattactagcgatctttacggttaacaaaatcagtaaaaacaaagtccaggacctttacaacatggtgcctgaatgtaattcgaagtatttctcatggcccacatgtgactatagtatgtagtccacctagtagctagaaaacatattacaaaacatcaacgaaaaggggagaaaactcattttttttcctgtcagcttatcgataatcacaaagtgtctttctttttaggctgtgtgctaggggatgtagatggcagttcaaaatataataaaacaaataaatgcatttatggattatatagccaagtggtgcttctcttccttgaaatggtgttcagttactaactggaaggaaaattcttgagtctctcaagaagcataagttctaggggtatctgctatttaaagatttgccagggaaaacaggttcattattcttaatgtgccatgcacactccgacaaaaagttgggtggcctttaaccggtttacactgctgcattttcacaaatgaccttgtggccatctttgtgctataaaaataaagaacttttagagtcacctcatcatctatattatgcctttggttacttcactaaatacctgctttaccagaataaataattctaatttctttccatggagtttttcattagatccagaaaaaagaagtcaatctctttttacaaactactgccctaaagaatcatactttaatccgttggaggggtaagactgcactgtgacatgactatagaaagtagatttgtatcctagttctattatccatgtgtgtaaggcagagcattcgggaggtcattaatgttacctgacagatttttctaaagtcaaaattacaatctcatactatgaagtatgagaggtactgaaaagcagccaggattcaggcatttgcaatcaccttcaggcacaaggtgacagaaaactatgtctatagaaagtattgatttaatccattcttaaggattattgaacacaaaggcactatgccttgaacattagggcagttgtatgtttttcaagttggcgctaactgcaacacatttagtctcacacgtcaccactgcctgagggaattgttttccacagcgattggaattgagactttctggcaaagatccaagacctcaatagcaatctggtgctctattttttaaaaatacaattcccaaataaattgttagcattcagttgtccaaaggaaagccggaatactacagggaaatttgcttatcttttcttctctataatttaatctctgaaaaaaatctgctttacgtacatttgggatattttcatagcattaaaaaaggtcattattgttttgattctttggcttctggaaacttgtctgaacaccatacacctcaggtagtcaagtctgcaaatgcctatataacttcaattacatgtgctagccttttctgaaattcatttgtgagtgaaacatgtttaaggtggtcaaaattatggtgcatttttctacaaaaagttaaaatgaataaattttaaggggcacttaccataagaatgaacccaagaagtctcacatacgaagtacatgaaccaggcaaaccgtcaggggcattcaatgcttcaccaagtcaggtttcctcaatttctcctcccagcctaccattccctccctggccccactgcccaaagccttggaaggaggcactggcacagacacactgaagaatcattaaattgattagacttgtatggcatgatgttggcagagttttcattacgactcctgtgtttaaatgaatcagtggtctctccagtccatcctgttgctaaggaatccagaatcttctcatttaagaaggactctccacccatccagcctgtctcccagaacactgtcatcccatgggagagctttccttctctcctccttcagattaaattcttggtaaagacaaccttgattttacttgggctgtcagttaacactttgtcatccaacagtcacttaattaggtaattcgatattcagacaatattcctggtggaataggagtaagaagcatctttcaccgtaaaacctgaaaccacattcagtgataagactgcaccctatccctttcaacccataaataggcattttaaaaacctctcaaaactccaatatttaattttttaatcgaattggttattgttctgtgtggcttcaaataccaaataaaaaagatcatcttctgaagggtacgttgagatgatgtaagcctttcaaatgagagttaagagtgtgggtctggagccagactgcctggatccaaatccttggctctgtcacctgggacacactgcttactctctcattgactcagtctccttatctgtaaaacggggttaataagagtacctacctcacaggtttgtcatgaagatgacatgatgaaaaagatggcaagtgctgagaacaatgcttggcacacagtaagtgctcaaaaaatgttcgctaaaatgggagagaaagagcgtaggaaccaagaaaaaaggaaacaaaagcaaaatgaagtcatcccagaagaataaaaactaagggcgctggcagaaaatgctaaggtcctggaagtggaagaaagctttatgactcatcagttatgttcaaggctaaatttattttgaagattttgttagtgttgcaaatggcaacagatgatgaacggcaggattccaacctagggactacaaaggattgccattttaaagagattcttgctcccaaccccagtcttgtcgtcatggtgatgacaacggcaatgaacatttgaggaatgttcctcatgagctgcaagtggagaggtgactaccatccttacatgatgacacaatgtgtaatacacacatgcgcgtgcacacacacaattcttacacaaacgccaaacataaaaagcaggatgagacagacagaagccatggccgtgagcctgaatctcactaacctctctcattggctttccaggggtatttcttcctttaataatagagagaggaagaggcagagatatcagaaagggaaaaaaaacatgcataaatatacaatttcataccaatttgcttcttttaccaaacaaatgttgagatgaccatttattctctgctggaaaaaaaaaaaaaaaaaaaaacagaaacaaaaaacccaaaagacacatctagtcaaataacctttacatacacttaagatcagtgtaaacagataacatgatccagaagacgtcatttgtaaaatccatagagttcacgcattaaactggatgaaaactggcacagaatagaaatctgacaaattgggcattgttttcaaggacaactcaaacttaatgttaaaaaaagtctcagaatctcttcactcttgacaatcagcacattgaaacataaacagtagttgactctgtgtgcccaaagtctgcacatcaaatgcaaggtagaacccgacatagaggctggactccatcctcttgggagaatttgttctatctgatagaagctgagcatttccatgatgaaattggaggcatttgagaaaacagaaagaacagatgaggggaagaggtaagtcccagtaatgggcaagccacagagccagatccaggaatgagctttccacttcctccccaattcagcaaatatcaggagccttacgaggcaatggctaaagacccactggccttgattcatagattcctacatctgtatgcatttatttgtatttcaaaagtagactctgatgagaaagtgttctatgataagtcataattggacagaaaagtagggacttctgtccatacatgtcaatagcctgtcttgggcatgcaatttcctttaaaatcttggttttcaaactgttttaactatagcaatgggacatctcctaaaacaatcttatatggaattccaatattttgagcagttcaaagcagagctgtgagagatcctgtacagcatctccctttcccctccacccatcattctcagtggctccaagaagactaaaaactccctgaaacaatttgagaactactagtctggaatgaagaggtatggagctacgacaccaatagaaacctttcaaaactcactcaaggttagggttcaaaacttctagtatacatttaaggatagtttctaagtttttcttccctctctccttctctttcttccctccctttctccttctctcccttcctctcttccttctgaatttcctacatgactcagcgatttcttaggagtatcagattttcagcttgaccacgtaagggccaggtatttaagatgctcctcaagccagggaaaagagggagaaaaatgggtactagctcctcagctgtgggtgtcactagtgggagatccataccaaatgatgttcccatcatttggggaggagaacatcattctttccttgatggctgaaatcccagtatgaatcactcaccccttctttttgattcctttagcaaggtttttttaaaaaagtatctttatgtttcataatactgtctggtggcagaattaattcccttcccctgtaagactataagcctcttgaggacggggtccacatgttgctcatccacctctctatgcccaatgccctgtaccgtatatacacacttttggtatttgataaatactggctgaagtgaattggtaaagtagtagttgggtcatgaccaagaggagtccttctgtgttataagtaacttgcccttcactggcacactttagtttggatgccaaaggtgggtaacttgtttcggcatgtaactttggtctagttttgaaaacttgagatctttaggaaggacagtgttgttagaaagccatgtgatttagaatgtaattatggttatgtacttcagaatgtaacgatgattctttgaatgcttaatgatacatatctttagtaattctacactaagccatattcagaactcagttatcaattgattatttcttaatatgtagcagcaaatgacttgtgttatgttccagatccttcttcagaaaccatattttatgaaaatggacctcccagagccaagctaactctaatctcttctaaaatcctccctcatcacttgggtccccacgtactcattaacacattacaaaaggaaggtcctttttttcactttagaaaaagttaaaaacaaatgatattttctactgtaaaaggactagttctacgctgacaaaacagaggctacttgattacaacatttttaaaagttcttgaccgataaataaagtttcagatatgtttcattttctaaacatttatttttttttggaaatgagtttctgtagaccttcagttacagtgtccatctggcaatgtgatgtgttgtcaggaaatgaatcaagacaaaagggaagtgtgctggggcagtcctgagtctaaataaagggcttggtcaggtcccgagaagtctaatttcctcgggcactataaaattgacattattgattgtaattcattattttagagttggaattgcaggacagtactgtttctgggtgcttttagcctcttttatattaattcactgactatttaaaatacttaaggaagaataagtccctttttaggatttctgttattttataagtcaaaaaaattcaaatggccacacttgcaggctctttggtgaatatgaatataaatctataaatcaattcaatttcagctcaataatcttgttcagctgaaagttgatcagcacagaagcctgtgactctatacatgtaatgagtcagaatggacaacgaaataatagcgtaaagcagggattggcaaattttccccataaagggccagatagtaaatatttcaggctttgcaagcccacggtctctggaccagctattcagcactgctgcaactactctgccctggtaatgagaaagcaactataggcaacatgtaaatgaatgggtatggctgtgttccaataaagctttataaaaacaggtattgggccagatttggcatttgggctgtatgtagtttgctagtcctggattaaagggataaccgctcaaatcctttgtgggagcatacaggaaacagaatggtgcctgaaaaagggcacaccatatttctatctgcctttgttctttatgttgctcttccataaaagaaccacagaataagattttaattttaaaagacggtaggttttacaaagctgttgggttggtaatttaggggtatttgatagaatgtacgcgggcttatttgagaggggatggtatgaaaaaaagaggatggcatgggctggtggagataatgtggcacaggtcagtaggcaagagattgtacaggtagcagaaatagtagcactgctaactgctttctggattgttttactgcattaagagcttatcttggctcctattattcattcatctatataaagtggtaccacattttagagagcctaataccatactactgactaggagagcgtttctttcatcaatgcacatacatataaaaatatctttgttagtctgctaaatgatcagagacttatggacaaatcacttaatggggttattttttaaattacgtttgtttattgtacccatgtagttttcctatagaatggcagagctttagagagtaccttatagtaaagtagataatgacttattacactataattcaatttctacacatatacttacaaaggaagagattagagatagacagattagatagaaattggctaatattcagtgttcaaatatacactgagccactcaaatctcccaagtgtttgtgaacaactaagtatatctagagaccaaccagaaagatataatcacaaagctgaatgtttacacattcatatcttgaatatgctcctgcttatattgcctattatgcaggatagtgttggccatcggtttatcactaaatggagaagcatgccactcatttattaattttgataacagtttagcaaagccattaagataagattagaagcctaacttaacctgctgaatggccataaataaggcacttgacttttcttggcttccaggtactctttgtgaaaataaaagataaagaaaggttagctgacaccttcaggaccaactctgtggcaaggggcaacagaaaagttgtaaatttgaggtacataatagcttacctatctatatactttatgtttatgaagagcataagttttttaaaaacggcttttcctctgtgggcaattatctagcagggttaagtaaaccacgcggtggtatttaatagcacatttccactaaatgtcagacctctggctctcacatctgttttgagttactcaaacagctgtccaaaacagctgtagcaatcatgaactttgttttttgtaacacaacaatgagaacatggatggtagtgttagaataaaactataaaggtctctgagacattagcaacgtcttggcagaaacttccacggcaaaaatctcaaaatttaaatttttttgaaagataattcaaccaggcaagaaaaactgagatcacatagattagtatttttaaaccactggttcagaaaatccatttagtgggttgcaaccagcattttgtttttaaataaataaaatagaaaaacagcatgcactgtatgtagtatggaaggcatcacttgatgaaacttttgtttctgatctttgtatgcatatgacactgtaaatgtgtgtgtgtacatatggtgggtgtatatatacatgtgtgtacataaacacatgtacaatttattttatatctttaccccagtttgtgatgtaaaatgttcctctgatatggataaccatcaaaacagagtcagaaatcactgtcctggatgtcaaaagtgttaaaatgacctttcaaggctcttccatttgaaagactttgtaatcccaagatgttaagattctcaagaatttctgcttaatatcagctgaacacatctaccaactggtaagatgttcccgccaaacttgacggtatatgtgtgtgtacacacacatatgccatttttcaaaattaaaaaacaaaagtgcttttagttggaaagaaagcatccaaaaaccacttttttgagtgcatcaataattagcctaatttttacaataatgaaactttttatccacttgaatttggggagaaaaaggcctgtaagaaagcctgagttagctgaaagtagcaaaacgtgaggaaatgccaagatcatggtattacagaatgataggccagattttccaataccttagctactctcttgtgttttttgtgtatttaattgttttgttttttaagaatgtgaatttattttctcaggccacaagggtaccactgagtaagccggaacttaagttaatggaattggtatcggacaaggcttccttctcccacatttgagaacttaaatcagcccttaaggcctgaaattcttccgtaagcactaatttagtaaacactatccaggtggcctgaattgagtttcccaagtttccatacaagtaagtaaatcaacatcagagatactgactgctaaataccatatcagaggaggtatatttcttgtcttccaggaagcttctacacccatgtggtatctagctttaaggactctaaaagcgggacacagggagatggtgcaaaggatttcaccttacagctaattagggtggaccagaaactcaggtacaaaaaggagtctaggaagtcaaggctgcctatgaagaagcagagtcatgagccttgctgtagcttcttctctactaacctcttgtttagatgtggaagaaatgcccagggtgccaacagggcagccagcaactttccagagcaggtaagcaagctgccagttcaaggggccaggatcatacagtaatcaatgattgtactgtgatttgaatttctttggagttctgtatctgcaattgaccataagtaccttgaaggcaaggaatttgtcatttcttctttccatccctactacctccactggtacgtagtaggtgctagtaaaagcaagcaggacaaagtaatgaggagacacgtgaaagcacctgattctgtcaagcctgtgtatgatcttctcattatgaattatgacatctagaagaaggagatacctaagatagtcagaatggggatgcgggtggcggtgggggatgtggaggtgggtggaagacagataagatttttatctgttaaaatcatcacttcagtggcgctcagcagtgaaaagatggctggtgcagacatttaaaattagcttcccctgacggttccttagcaacgctctaccagaacattattgcttttaatgtgcactgcacaacgtttacttgcacatcaaatagctaggaaatggccattgttaactgacactgaacaaaaagataggaaaaacacactactcaatacaccctcctcattgcccttatggagaggaacaaacagcccagatttcctgctgcccgtccctcccaggctacccattagaggtgccaatcactggccacaaagccttgtgttttctcccttttgtttctctaggcttttcttctatttgatcacaggtgactgccaccatcctttttattcgttgaaggaaggcgagagagtgactttgttttatgtgagggcaataaaccaaataaatgcccccagaaacgaacagtagcagcaaaacatcatcttggatgaagcaagacatctgaagctcatgcaagccagtgggaaaattctgcagggtaaaatgctgtttttgtatgggggtaaaatacgcaaggccaaagtgatgaagaaaaagaaaaatattaatgtctttctttgctaagcctgtatttcctctatcgaagtaaaaaataaccaactactctatgaagatttaattgtccctatatttaaatgatggagtaagatacaatttttaaatataaagggcatcagatggcaagtcagaatctctaccactaccaatcagtaggcattgttctaggccttgctgtagcacgtagtagccatatgtccctggcaaaggcactatcagggcattaatttcctcatctgtaaaagtcacataataattgctcttcagtaaagggcacctcataattaactcttcagactaatgtgtgaagcaagtaaaatacttgacaaatagagggtggtattcttatttttggaaacatgttgccctcacgggtatttgaattcagagtactctaaaccacaaattcacacttaaaaatcaaatcttttcaccatggacccaaattgccattctgatactgcgtgttggcttccatatggaaaatacacacaccagttgggtagggaagcgagtggcctgatcccagcaaatctgagtcccttctaggtattggagcttacctcttgaactagggaaggagttgttgagttgctccatcacctcctctaaccctgtgcttgtgtcctggggaggactgagaagatcttcctcaccttaataaaagcaaaaacaaataatggaaaattacatttatagaaaacagatattaaagggccatgattacatttttaacaccattataaattcatttcacttgctcataaataacaaagaaaaccctcaagcttaataatgaggaagtaattctttaaagggaagaagaaatccatacagtagtttatctatatcattacccttggagaaaaaaaaactgtatatctttttttttttttttttttgagatggagtcttgctctgtcacccaggctggagtgcagtggcacgatcttggctcactgcaacctccgcctcccaggttcaaacgattcttctgcctcagcctcccgagtagctgggactacaggcatgcgccaacacgtccagctaatttttgtatttttagtagagacagggtttcaccatattggccaggctggtctcgaactcctgacctcatgatctgcccacctcagcctcccaaagtgctgggattacaggcgtgagccaacacgcccagcctactgcgtatctttttaaaagttgactagttacttgaaatgtgccccgcacatagaaatgataaatacatgagataatgaatactctaaataccctgacttgatcattaacacattctgtgtatgcaacaaaatatcaaatgcactccataaatatgtacaaatattatactacagtaaaaaacaggctgggtgcggtcgctcatgcctgtaatcccagccctttgggaagccgaggtgggaggattgtttgctgccaggaatttgagagcagcttgggcaacatagtgagaccctgtctctatttaaaaacaaaaaaacaaaaaaacaaaaaataaatttaaaagttaaaaagaataaaagaaaaagtcaattgaaaaaggtaaaactgacaagctctcttttgtgccccattcacaaatgtgaaactttgttctatgtaataaaataagtattactgcacacttgcagtgctgtctcctcaacacaaaagagtaagaattgaacactttgcagtcacttcatgaaggtaagaagggagttgagacactgaggtctttttttcactctttgttttgacatttaaccaaaaatacaaacgaaactcaagtacctttaaactccaatgtaatagaaataaaaatagtatatatcctatataggtaatgaaatatgaatattctaaaaactgtagatatggcatatattggagagttatggtcctttcctctgttacttgggactactttatcataattatgttttgggttttataaagaagacattacaaacattttgactgtttatgtgaggagagaatgatgatctggaagcaaagaaacctatggatggatgatattcactgggaatggaaatctccttgtagattttgtgaatctgtgtctgtattgtttgttcatgtgttaaagaaatacacttcaaacagcatttgcaagttaaagggaaatttcttaggtgcaaacaaaattaaactttaaaggtcctttgaaactaacttttcataatatacaatcttccaatagtgaaaataacttctattcaagctctgtttgttttgcacattgtcacttccatctaaaacaagaccttgctttagcaagtcaaccataatgaacttaattagggacaacctcaggtttacatctgacttggaactgcttcggaagccagtgactaaatgacttaaatatgcttctcattccctttggtctatgccacttggattttcatgtttgattagaatcctgcatttattcctttttttttttttaacagcagaagctaaaagaatcattgccaatgctaaccattaagacaaaatcatattctaggtggatgtgaggcttcatatttttattagaatggagggataagaacgtaaggtagataaaaagcctcagactacatgagtctcctggtaacataccacaggaaacctctttgcaatattaagtacaggaaatgggtgctgaagaattaaggtcacaaagcagaaaaggaatagttacaaactctctctctcctctttctctctctcttcctcccccctcacacacatgcactatttgcttaagtttatgcctttagaaaaagaagtgaaattcactatttttagtttcatttttcttgcggttttaaactaccattatctggtgaagatgaaatgaatgaaatactaccaagaggatcaagatcctgacaactgcagggctgattacatctctctgtttcattactgatgcaaatttttgcggaactgggaaacatgaggcatttttaatggcagtaagtccacttcagtgacagtatgcctcactgaataaatcagaaccaagagaacatcatgaacgacgctcatgaacatcgatgttaatatttctgacagtttaattacatcatattggagctctaggaactcaattgtactgtgttaaaattcaggtacagttcaatgaagtgactggcattcctgttcctgaattatttcaaagatcaaattataaagtataaacctaatgatgtcagccaagtttatttttccagataaactctctgtgagtctttaatatgagtgtccaagtataatacaaatgtaaaattggcttctttgctttaatggaaaacttttaaggcagtgataattgtatccattcagacatttttttgagtgcctattacattctaggtagtataaaaacaagtagagtataatcttgttttcttcttttctccatattttcatgatttctcaagatggttttaatgcattgctttttttctctttttctttttttttgagatggagtcttgctctgtcacccaggctggagtgcagtggtggaatctcggctagctgcaacctctgccttccgggttcaagtgattctcctgcctcagcctcctgagtagctgggactacaggcgcgtgccaccacgcctggctaattttttatattttttagtagagacagggtttcaccgtgttagccagaatagtctcaatctcctgacctcgtgatccacctgcctcggcctcccaaagtgctgggattacaggcgtgagccaccacgcccaggctcatctctttttaagaatcgaaatcagacatcacatatgtgcatgagtagaagtgaatcaactcattgaaaaatgcttaatgcctaatattttctgtgtcagaatatattgtaaaagttaaaacagctaaatgaaacctgaagttaaagtaataccattgtaatatttgatactaacccagatttttaaaatgccttttaaaaaccacaaaagtttaaaaacagtaagattcatttatttattcaaatatttattaaaatccaactatatatgccaggcactgttcaaatggttgaacagtgcctggcatattgttcactgaagatatagcaataagcaaacaaaccccacccacacactctctctgtgaaactcgcattcataaggaggcacacaggcttaacaagtaaataagtaaactatataggtatcttgagtggtgatgaacactctgaggagagggctagcaagggacaatgagagtcatcagaaagtggagtcttggaagtcctcattgatgagatgcagttgagcaaaagctttaagaactggagggtatgagttgcacaagtatttgagggaaaagtgctccagacagaaggattggcaaatgcaaagactctgagaggagagtgtgactggcttcctcaagcacagcaagaagtctaatgtagataaagcagagtgaacaagagctgggaaaacagtacttccctggcctggggattcggatttggccacataacctgctttggaaaatggaatgtaagcgggcatgacaaaagtagaggcttagaatgtctttgactggttggggttgcccgcttgtgtttatgtgcacaagaagcatatggcccaggtagcttgctagcccaagaaggatgagagacatgttgaacagacctgaacccaaaccacaacttggtgtcaagtccagctgattgccagcaaaagttcagccaaacaacagatgcgtgaatgagaaatatgcaacttgagaattttgtggttatttgttatgcagcaacagctgactgatacactattatgggcatgaaacaagccagatataatatttatggcttgtctaatcatacactatgtagctacaacataataggtgtattaatccattttcacactgctatagagatactacctgagactgggtaatttataaaggaaagaggtttaattgactcacagttccagatgcgtgaggaggcctcaggaggcctcatgattataagtttagaatcatggtggaaggcaaaggggaagcaaggcacctcttacatggcagcaggagagagagagagagagagagagagagagagagagagagagagagagagagagagagagagagaagggggaagtgccacacactttaaaaaccatcagctctcctgagaactcactcactatcacgagaacagcatgggggaaaacttcttcatgatccagtcacctcccatcaggtccctcccctgacacgtggggattacaatttgagatgagatttaggtgggaacacagagccaaaccatattaataggcaacctcaaaatatttctgactctaacaataatacctgtcatcacaagcccctcatcaccaaaaacaaaaacaccttttcacttttttcacttattcaacaagaaaatactgagttccagttgcacactagagacctgcacagcccttatccctacttcacagattcattgcctgctcaaatagcatattgctagtctttgggggattttaaacttagttgatggcaatgctttaacacttaaacttgactctactccaaggtgatttccacaaacatgcataaataatagatgtcagtgtggatgtggtgaaaacagaacacttttacactgctggtgggaatgtaaactaggacaaccactatggaaaacactatggaggctccttaaagaactaaaatgtagaactaccatttgatccagcagtcccactactggatatctacccaaaggaaaggaagtcattatgtgaaaaatatacttgcataccaagattatagcagcgcaattcataattgcagaaatacggaactagcttaaatgcccatcaaccaacgagtggataaagaaaatgcagtatgtacgtggtgtttatatacacacacacacacacacacacacacacacacacgccatggaatattagtcatgaaaggaatgaaataatggcattcacagcaacctggatggagttggagaccattactctaagtaaagtaactcaggaatagacaaccaaacattgtactttctcacttataagtgggagctaagctatgcggatgcaaaggcatgagaatgataccatggactctggggacttggggggaagggtgggaggggggtgaaggataaaagactacacgttgggtacagtgtacactgctcaggtgatggatgcacccaaatgtcagaaatcaccaccgaagaacttattcatgtaaccaaacaccacctgggttccctgaaaactactgaaataataaaaagagaaaaataatgttttttggattattagctatttggtcttcctggcttgtctgattgtggtccaaataaatcactgaaacattttttaaaataaggaaagacatagtcaaagttaaatagtaccgtgatatagcaaaatatgatagtctcctttaatcactgctgaagtgaagaaaaaagaagtgggatgactcaatttaatccgagaaaaaagaaaaggaatgctttgccatggcaagatattcttcagtcttctgaaatataacgatggtttcagatccctttcttgaagggaagatatcccatctgactcacttccctttgattcaaacgctgataatggttctatctgcttaaaaagtgattttagccagaacctacgcagcctatgcagaatagacacaagaattactcctgtgtttttgtctgaatctaaacaaattattttctcttttttttaaaaaggagctgtgtacaagaaattattttttctcataaagggggctgtgtatgaacaaatacgcccaccaacatttttctttggattttaaccagtttccgacttgatgtgttattatcttagtacttgtgtatttcctgcctttctccagtattttttagaagaaaaagcacactgatgtatccaatacccaacatttggctacaattaatttttttccatatgatataggaccgatgctttcaatttcacacataaattctgtgtgtaacacctttaacatattatggtgtacaatgttgttgctgattattagctgatcagttgtgaatggtggtgaaagatactgaaactagtagctaaatttcctaaacgtgtgggctgttccatgtgtacacaagaatgtattatgcttgatttctaaaatattaactcaacaagcactttactgattgtttgttgcacagagtatcctcatacagtaacgacaatgagcaagacttacatcctgtccttaaggagcttaagttctagggagttgtaggcagaagaaagaagtactagtaactggctgaaaacatggctgggtgtggtggctcatgcctttaatcccagcactttgggaggctgaggcgggtggattgcttgaggttgggagttcaagaacagcctggccaacatggtgaaaccctgtctctactaaaaatacaagaaaaagtagccaggcatggtggcgagcctgtaatcccagctactcaggagggtgaggcaggagaatcgcttgaacccaggaggtggaggttgcaatgagctgagatcgcaccactgcactccagcctgggcaataaagcgagactccgtctcacacaaaagaaacaacaacaacaacaacaacaacaacaacaacaaaaccagaatgatataatgcatgattaagttccaaaagaaaactcactgagtgaaaagaaaggatgctatatttcaggttaagaacataatgtactcaaggccaaagagcacatttattctgttgtcaaacagaaggcataaaatgcttaaagaggggaataatatgatataatttgaatggtagaagaggaactgaagtttctggaagatagcttagaaagggagagagaccaaaggcagaggaaccaattaggaaagtattcatattgtctgttcaggtaacacatgatgagggctaaatttgggcagaagtagctgaattgaagaattttgctctttttcataagtagcaaaacacactgaccttggtgactggattgatggtggtggaacatagctaaggaaggcaggtaaaggaagaaggggtagaaaatgactttgtatagattgggaaattggaagagatgctccaaaggttgatcatgatttcagattaggctatatttttatttataattttatccagaagatgctcaggtgggaggtctgggctggaaatcttgacttaagagttgtcagcatagcagaagccaaagtatggaaggagcgcccagggagagtgaagaacggtgaaggggatggagaatcttgaggaaaaccttgatgtgatgtactgaggataccttacctatatggtaatctggcataaaacatttaacccgaacccaatcacttggatacaagcagacaaattcaaattgggggacattctacaaaacatctagcccgacctcttctaatatatcaatgtcatgaaagatttaaagaggctgggaaagtgcttcagattaaaggagactacagggacatcactgatcctgaatgtaaaatatcgctatgaagaatattaattggcagaattggaggtatttgaatttaaattctacattatataacagtattgttctttttgagcatgataattgtgcttatgcaagaatatctttcattttagaaggcacgtgttcaagtgtttaggggtgaagtgttatgtatgaaacctaaccattgagtggatcagtgaaaaaaaaatccacaaactatatacacgcatgaatatgattaaatatgcacataaaatataaacatatacagtatataaaaatatgttaacatacagatatacatgttaatctaaatatatgcaatccatttaacaacacatgaatgtaaaagtacataaataaatagctataaagcaaatgtggcaaactgttgaattaattgcagttttgccataagtttgaaattgttctaaataaaaagctagggagccattatgtcataaacctcaaatgtacatgataaattttttaaaaagcaaaggaacagtttaatttttaaatcaataaaatataaaatgcttcaaaaaacagtaatctggtggaaagttaggagtcatcagagataaggagttgtctggacatcacagatttgtatatggagcccatgagagccaataggggataaacattgttaattgctattttgttctgtatttgcttcctccaatagaatgtacgtttcattagcacattgtctcagtaagaactgtacagaatacaaatggtacatagagactcagtgataagtatttcatggcttgaggaaatatgttgactctttagacacatcacctaatatgacttgtctcatgtttcacttaaaagaaaatcagtcatcggggttgcatatttaaagaatgcagctctatccagaatgtggttcagcagatcccagccttgtatctcaaaccttcaaagcccaagtatatacactgcatttatttaaacacctgtgtgcatccttcaagaagacggtaaggcttttttcctttttaaatgaagttagcttatgcagttcgatatggtttggttctgtgtccccatccaaatctcatgttgaattgtaatccccatgtgctgcgggaggggtccggtgggaggtgactggatcatggcggcggtttcccccatgctgttctcatgatagtgagttcgcataagatctgatggtttaaaagtgtggcagttctcccctcgctttctctctcctgccgctatgtagcacatgccttgcttccccttcaccttcccccatgattgtaagtttcctgaggcctccccagccttgtggaactgagtcaataaacctctttcttcataaattacccagtctcaggtagttctttatagcagtgtgaaaacagattaatacacagttcaagaaaaagtacccttgaattcagtcttttctttcagaggacaaatttaacacagcttatccattttatgccagcaagttatctcttagcttagccattggaatatagcacttttgtcctggtattcagttctaccatgatctttttagctccacagatcatcaggaccacatcctaatgtgcactttaatttgagtgctttaacgagtatgctgcctattcgccattgtcaacgacctaaataattattaatgcttctaagcacccagggctctgaatctgaccactaaaatatgtaacttagtttcatatgctttacttacttaaaaaagggggaaaatcctgaagtagaaaaaaataagaggtactaaagctcagttgttttcagaatttacagactttgcaaatgcatacagttgtttttcatgtagtgtgttgtcatttacaatcccaacagtttattagctatattcagatctcaggtggagggagataatctgacacagagattgccttaaatcatggaggtgtagtaaattcaggaaaataacctcaaacatatccttttccttctcaaaaaaatcaaaacctggctttcctacaagatttggcttctccagaggaggatgtgcctcttcccactgctccaggttcttgaacttcatcacatttatttcaactaccctgtctctttcctcagaaatgttcatctcctcagagccctcgtccatcttcttcaacatcttttccatcctgatctaccactgtcgtcaggatctggacctcacccctctgctgataagctcagcaacgttggtctcatcaactccatgaactgtactccctacccctcagtgatctccaagtaaaatcttcagcagctcgctgggaggcaccatgttagatgtagaaattgcttgaaagtattttacttccatgatatccaacttttgaattttcccgactgtgatctccaaatttttcgccataaaactcacccacacccctgacttttcctttctgtcctatccattttggttaaggcactttgcctccctttattctaccctcatggaagagctcaagtatgaaatgaattcctgaacacatcatcatatcaggcaatagagctgtaagtgtatggaatcaaggagtcacaggtcttttctattctgtgaggtaagatttgagaggaccaagtatataaccagtttaggtcccagggaaaagtaaggagagaggatggagctgactcctactgggcctttacagagaaagagaaatgaggaagggggaccaagtatttgtggccttcataaaaccctctattgtctagccagacacagcaggaaaaaccaatgagcagctggctaggaacccctgtcctagccattcattaccactgtaaaatgccctactcttgttttgacctttgatcatttatgcctcatcagctccacctttcttagaacctagtcctaggcagagaacattgctaagaatgagaacagaacatgtggaccatttcctcaacaaattcatccaacttttgcctaaggcttccttcttacttggtaatgtttcaaaattgtcttcactttccttaatcctcattcattttaagattacctagtctttcatttcattgaaacagaagttttccaccttcccttctcttggcctaaaatggtttctcaaaattacccaatgcatttatagtgacccaatggactgtgatttattttaatttccattgagctctctttagcatttcacctttttgtcacatcttccttgaacctccctacttatccatcctttactatcccattacccaaatggaggtcttttccaaggcactggatcgaagcacctgtgttatagattttatagatttctcatctcacacccttcagcaatcaattctatgaaactcattctcaaatctctccagtttgcccacttacttcaagtatagatctgtatcttaatttcttttgggacatgacttagaagacctgtcaatttctcaaacacattatgtccacaatcagaagtttcactatcttcttccaaccaaatcctctcccttcattcctcttcttacaatttgcactcagtccccagaccctgggaactctattttttttttttttttttgagacacagtcttgctctgtcgcccaggctggagtgcaatggtgccatcttggctcactgcaacctccgcctcctgggctcaagcgattctcctgcctcatcctcccgagtagctgggactataggcgcccaccaccatgcctggctaatttttctatttttagtagagacagggtttcaccatattggccgggctggtcttcaactcctaaccttgtgatccgcccacctcaccctcccaaagtgctgggattacaggcgtgagcctccacgcccagccccctggcaagtctatttttatagaatagtctcacagtcctctcctcccacatctctcaagtgcaggccctcagaactcaccaatcttggccttggcaattgcctcctaactggtcttctcacctatacaagttttctgtgggccagatagagctgccagaatacacctttttagaattttctttttagacttttttcgcctggtatatgattttcagtggctccctgataccaagatgagtcaaacacttacggccaaatattcatgtccctgtaatacgactctacctttcttcagacaacaaaatctgagagtagctaggacacttacccatggagtccgaagtttgactgccaaccactcggagcagcataggctgactgctgtcggacctctgtagagaggtagaaggagaggacaccgttgtgccattcactttggcctctgcctggggctaagtcatccaaaagaaaacagaattacttttcataataaacatacaaatgtataaatttcaaaatatgatacacactcaggactcataaattttgacccttcctactttagaagccctcccaaagattgtttaatttgggatatttcactgttgatataatccatagaaactgtctttgtatctgaattgtgctcccttataaatttgagaaaaaaatcagagctacactggaatgagactatacatcattacattaaataactggaagatttagaaggtcatgtgtgaatgatgagactatgtgagatctcaaaactgtaatggaagattcatatctttgtgaagtattaagtaacaagatagagagaacataattgaaaaatttaaaattcccagaaagccagaactatgtccaggtaggtcctcttacaatgcagtatcttgctaggttttcgatggaggcttaaagaactatgtgttagggattaggagaaaaaaaacacaaaggtataccagaaaatataactaattgtaaatgaaatagttccatttcaagaagtgaaatattcacttttagagaactagtggaaacctttaggcgtttttttccccaagatgtatttcaaattggtcaagaaaaaaccattttggtaggaaacaatattggacaaatacaaaaaagacacactagtttttctatctcctctacttctatcctttgatactatcactttgcaggcacataccaagcacttaagaattgatgcttgttgcacctataaaaagtgctctctgaggtttagttttgtttaagagggaaaaatgaatgtttgtaaaaatcccatctctctcctcacttgctccagcagctgccttagcctgtgtaactgtgactccagctgtttattgtggtcttccaggatttgcatcctggcttccaggcggcctttgtgttgacgcagtagcttggcctcagcaatgagctcagcatcccggggactctggggagaggtgggcatcatttcaggaggggacggcagtggggacaggcctttatgttcgtgctgctgctttagacggtcatattctgcttgcagattcctattggcatcaaaaaagtaaaaaagaaaaaaaaagaaagaaaaagaaaaagaagaaaaaaagtaatttgaatatcatcaccaaattttatataccatggtagatagatgcatctgactgccaccgaagaacagcaagcaaaagaggcactaatgaatggttttaatgatgacaatcttaccagtgctaaaagaacaaaacaaaatttgaagcttttgcctggtgtgtgaagggagccatgcttttcaattttttatgttacactaaaagcctcgcgactggtatgttcagataagtaagcagcaaaggatttaatcactttgtaaatatttctttataatgtcatgagattaaaaattttatacctctatcaacactttggtttgctctaaacattagcaaatattttcaacagaaatgtataagaatggagtaagtatacccatgttcctatcacctccccttgataagtttatcatttgccatattttcttcaaaagttttttgaagaaagaaaagttaacagccaaagcagaagctccctcacatgcccgcctcaacaccataccattctctcctccccgctgccctcaaggagataatgccacactgaatttcatgcccagtgttaccatgaatgtatcaacaaatactaggttgagcttaaaaaagatgctgatgtttgcctgtatttttctttcacctacaaaaacacccattttatgtgattcaatctaataacattattttgcatgtttttaaactttaaatttaagaacttcacatttaagaatatacataccattctaagagttgctttttgccttcaacaccattttggagatttctccaggtcgatacataatagtttgctattttaactgccataaggtattattattctgttgcttgaatatgccaacattttcctgtccatggacatttaggttgtttccaacttttcactattataaacaatgatacaatgaaattcttttttatacctatctccttggatacctgttgaagagattctttacagaatatagtttgatgtggaattgttggatcttagcaacatcttcaacattgctacatgtcaccgaatcgctctgggtgacaaatcggtgcttttaccaatttactctcgcttcagtagtgaatgaggttttccatttggcccacctcctcaccaaatacttggtgttatcagacattcaagttttagttaacctgatgggtgcattttaatttgcacatacatcccggattactggcaaggttagacttcttccatgttaactggcttttcatgcttcctttacccattttcctgctggattgtctttttctttttaaacctttggatatgttctagatgctaatccattgttagttatgtgcatggcaaatatgatcttctacccttatcttagtgtagcttatctttaactttgcttatggcatcctatggtataaaagatgtaaattttaacatatccctgtatgttctctgctttttatgttttgttcacgaaaatcttttcttacacctacattttaaagtttaaaatttggtttttcacatttaggacttgaatttacccagaatctatttttgtgcttgccgtgaacatgcgatctaattttacttttcccccatggataaactatgaagccagcctcattcattgtatggtccatctatttcccactgatctctaacgatgcttccgcaaaacatcaagtgtccataaatatacaggtgtgcttctgagctctgtattctagtctgtggttctatctgcatatccctggtagatcccacactccagctttaaatcaattgatgtctgataggccttctcagcccactttgtttttcctcaaaattgtcttgactattctgacccctttgatcttctccatgattttagtgtttggttttctgattttatgaaaatgcttgttgaaattttgagtttgaattacattgaattcataggttaaactgggaagaactaagttcataataattgagtcttcacatccaagaatgcagtgaagctccttacttactatggtctcattttatgtccattaataatgttttacttgttactcttttttttcctcttgctttacaggttgaataagtcattgattttttatttttaatgaacacatttagggttatacatttcctccttggtaccactttaattatataccaaaagtttttatatacatcacctgattcaattcagtgccttatgttttgtaattcttactgtgatttcttttaacttaacccatagtcatttaggagcacagtggttatatttccattttcacttcttagtgcatttctaatttaattgcgtttcaatcagagaacccctgtatgatactgatcctttgaaatttagcaatacttctttttgtgacctagttcacagtcactttctaaaaatgttcattgagtacttgaaataatgtgtatttttccattggaaagatggagtctctaaatacatagtgtgctgattttgttgttaaaattgtccatatctttattaatttttgattatttgtagctatcaatttttgttagatgagtgttgagatataattatggatttgttagtttctccttttaattctatcataattcactttatatatttctagacctatatagttagatgcacagaagatcctcgttgttcttgcactgtttctaggtagtatactttttcttcctaataatgttgattgccataaattttattccatttaaaggtttctatggttattccactgtcttttggttatatttggttaatttccaaataaatataaacagtattagcacatgtgaaggtcccaaatgctttaggatttactgagaatacaattccaattgaggacatttctgatatttgatatccagtgactgattagaactcttgacatctttcttctacttgtgataaataccaaaataagatgacagatttctgttgttcacagatgatatttcatcaggtgagagaaattcctatccacaaatgtgggagatctatatcaatgagaaaagagatgaaatgtaagtagtgagtagccaagaagagttttcccattgtccagtttgagaaagcaagatcatctcatcaccaggtctgctaaatattttctgttgtcccatactcggaatgaacattccacaggggacggcatgtcttccaaaatgctcagtttcaaaaggctagatctccacatggaagcagaaagaaaacccaatctactctggtttttttctttgttttgttttgcttcatttttttcattctacctagtacctaacattacaaggtttccaggaatttatttaaagtcacacagaaaatcaatgtatgatctttttcatctacagaaatagaatctcctatctgtactgattgaaatcctattgctatcagccttcaagggtagttgtttgtatagtttatttcatagcaatctgctttgacaaagcagtgatgagaagagattcatcgaagtaagtacaccttcagtcagattctgcacacgggtcttctgggtgtgcaccgatgtatgtaactgtccacattaattaaatctaatttctgagaacttaactggcaatcagttcaatgtttctgtgaacttgaagcagtatccaatgttcacaaggtctcattccataggaattactttctatttttccctcttcattaaaagaaaacttcaacaaaatgttctaactggcaacactttttatgtagaatcctattcaaatttttctttctaccagattggggcagccatggtgttccttttgaaaacagtttttagacatggacctcaagatggtacaacaagccattactgtcttcccacctatttttcacaaaggtgctgacaggagactgccttttctagagagatcttccttggtatcttgatcctgtgggtttagttgtccacagggctcttcttttatgatttatttataaggacccttgttcaagaggcatggtttggtatatacaacacattacatttctgttttggtggtttccagtgaaaacagaaaaggctcattttaatcagccaaagctgagctgtaaagaatatcaattgctcaatgcaggcctttctttccttcccagatgtttgaaatttctcttgggagcacatttccttcaagactcacatccttcttcaattctggaagattctcagctatgacagcttcaaatattacttctctaccatttcctccattttcttctgaaacctctcaaatacactcctaaacaaacctctaaattctagtaaggtatattgtagagcctgtggtcaattctccatttctcctaattgctcatttatatttcttatctttttctgtgagtgttgtacacagtaacattctcagcatcatcttctaattcccttgccttctctgacaggacaaagtctagaatttatcctgtatattgagtttagtaacttcaatgactagtttttttggcaaagatatctttgttttcagacctagttacatttcatccatctctgtttcttagtttcttgttattttagcgagtggtaccccttatttatgcctttaagcatctttttttttttttttgagatggaggctggggtgcagtggcacgatctccgctcactgcaaccaccacctcctgggttcaagcgactctcctgcctcagcctcctgagtagctgggattacaggtgcctgccaccatgcccagctaatttttgtatttttagtagaggcagggtttcaccatgttgggcaggctgttcttgaactcctgacctcaggtgatccacccatctcagcctcccagagtgctgggattacaggcgtgagccactgcacctggtctgagcatcttaaatgtaagtaaaaatctttgttgtactagtgtattattttgctttcttctagaattaattcatctttttttttttttgagatagggtctcactctgttgcccaggatggagtgcagtggcacaattatggctcaatgcagcctcatcctcctgggctcaagcgatcctcctatctcagcctcctgagtagttgggactacaggcatgtaccaccactcctggctaatatattttaaattattttttgtaaagatggcacctcactacattgccctggctagtctcaaacacctgggcacaagcagtcctcccaccttggcctcccaaagtgataggattacaggtgtgagccactgttcccagcctaattcactttttgatgtttaacttgggtggggggtgctatcccatttcttcatgtattttggatcgtgatttggagacaaattttgcaagggatgttttgcatgtgcatacatatgcatgtgtatgttttctattattctcatgtgtgtgtactttaatattttcctctctttttaaactcattatctctctctcaggtggttttatggcttctcccagccatacccaggggcttagagtttagagccacatctgttggtagtttgcagctcctacactgagtgatacagagatatcactcatttcattgccaggcagtaggtagattggttcaggtcctggtttcaaggctgtgatgctctctttcccaactgcgaatctttgcctcttccctcggctctatgcattagggccatagctgcatataagctgtagacccttgcagcaaactgtttcttttcatgttgcttttaagtgtaagtgtgtatgtgtctctctctaggtgtgtttttgtggggctctgatttcaaatagtaatcctggctttgggccactaccttgtaaggagaattttaatccctgttactacagcacgagctgaaagcccactaatttagccccacttacttttttttttttctttcacatttctggttcacagagatgttcatcttgctttaaagcccagctatgtctttttcatttttcactccatatattatctaccactggataaatggtaggagcagagaaagatgccttcaagcaagagctaatgttatcttaatcagaagcctaccaggacacattgattttgtagatgtatagtcaaggttccctcagtattaattcaagccttaattcatcaggccaggattaaatgagtcgaacaagtgcttttcttctaaacaaacatatgacatacagaaacctcttattaagctcaatagcaaacttgattttgagggactagtttttcctcctgaagctctgagataggacaagctgtcatgataaggattctaaaagccagaaatggttaaaagaggtatcttggcctgcaaccaaatgaaataaggttttttgatttgagtctgaattctcttttaaggtatttctaaatgttcatgagaattatcaagaagaactgatgctggagggtttgaactagagatgatttttactaaatgttttctaataaatgcagtcatagtcacagagctgtgttagggcatatttttgttaggggttgggaaattgagccatttagcccttatcaattacgcatttgaattttcttatatttaaaaacatctatgccaatactttttgaggtataccataatgttagttttgatgcagtattaacgtaggggagatcattctcataaatgatcaaggttccctcagagttactgttccaaggtaagttattctaatgttttttttttatttttttattttttattttttgagacggaatctcgctctgtcgcccatgctggagtgcagtggtgcgatctcagctcactgcaagctctgcctcctgggttcacattctcctgcctcagcctccagagtcactgggactacaggtgcccgccaccacgcccggctttttttttttgtatttttagtagagacagggtttcaccgtgttagccaggatggtctccatctcctgacctcgtgatccgcctgcctcggcctcccaaagtgctgggattacaggtgtgagccaacatgcccagcctctaatgtttaacaagtacacaatgcactcgttttaacagctgtcaattattaccaatacatattttgcttttcttgaaggtatacacgtacatctcacccctaatgattctctaattgttagaatgtagtcatgaagtcatttcaatacagatgaatatatgtcagtgatcagacaacgactccacagagaatctatttacgttcttgattatcttgtaaattatatttctctggtagctccctaaggaacattaattcaaattcaatacacatggcttctgtcactacaatttcttcctgtagccagtcatcctaaaaaaagtcttccatccagtatttcttattctctatagagctaagaatccccccattctacaaatatgtagatatatctgattaattttatgtcataaagaatataaactctgttgtctacatacaaatttacactcaaaaaaacttcccaaccaactaatggacataagagattaatcaaattggcaaggcttgttcccttaactcaacctgctgaaaacatgaaagcagctggcccttttagcaatgatttatgagtgcctctctagcaatcgtaactattatgtatgataaagaacattacaacaatctctgtgtaatttaaactaatttacaaaggtcaaatgatttcagtgtaagtcatctactctttaaatggagcttccctactacgtgtagttatatagttgtataatgatatttatgaaataaagaaatgaaggtcactttccagtgatcaatgttttcttaacagtatcatacatttaactgtataccaaagcatgagcacacacagggattattttgtaaagtagaacaactacaaagattgccatctaaaaggaatagatccaaagaaatctggctttaccctcatataatattaaaagcagctaaatcatatccaccaatctaaattcaggcaaatgtagtaaatcatacagaactattacagcagctataaatgtagccaatcagcagtttttttttaaatgaaagacaaattctgcaagcaagatgaactttaaaaactggaaattgcattgagcccttgaaattacaataaagctcagtgcaatggctcacacctgtaatcccagcactttgggaggttgaggtgggaggatcacttgagctcaggagttcaagaccagcctgggcaacatagggagacacccccaccatctttacaaaaaaattgaaaaaaattagccatatgtcgtgacacatgcctgtagtctcagctactcaggaggaggaggctggggtgggaggaccgcttgagtctgggaggttgaggctgcagtgagccatgatcatgccactgcactccaagctgggtaacagagggagactccatttaaaaaaaaaagtgacaataaaattttacagtacagctttagacatctttatcaaacacaaattcaaaaatacccctaaactaggtggaaaaagacattaataaggataagctcacagggtgagaagtaagactatgcatattttaggtcagccttaagcaaaacagtaaaaatggcaggacccctccaggctcttgtttctaatcatttcttagcactgtccccctttaaaacattcagagccttacttccaagccctttcctactgaaatttgctcagtataaaggttttatataagacatttacattttactgggattttataataaagttgtcatttcttctagtgatatctgcattttaaaacagatgtcaaagaacgtaaaggaaaaaaataaaagctttgccccatcaggggaaaggttgaacaatgccactttttgacacgctgcctttgtggtgcctttcaccatccatggctgaggagagaattagaacaaggcttgagagatggtcttggattcagaagatcttgatttatgacttacttgcctctgctgcttgctgaggctgggcaactgacttaagcactaattcagttatgaggattattaagccagtatggtcgacattctatatgtcaaactttctttgaaccatgcccagcccatactgtgttcaataaatgttggttactattattattgttattacttctttctctatatattatttactttttggatttagaacctcagatgtgctaaaaacttcctataaaaagaaagcacttaattatctgaaatggaagcaatctacttagacctactgagcttggcagaacatatgcatatctagcgcttagaaagtgactaatcactcagtatttgtcctgtagatacctgagttctagcccctagccacattgtagccacccccaaattttggaattattgtgtatcatccatcatctgtgccttagtaaagtttatcacagctgaacatctgggcaaaatgaaatcactgagttaagatcactaggatgagatttccttgatttgacccaatacgctaggtatgtgatgaaactgtcaaattataatatgtccatggatcattgctgaaataaaatatgtggaccaagggtacagggttaatgtatctaggtggagtctattttctggatatgtcattgacacgtagatctgtatcttgctcaagttccaagagacagaacatgacaatattaattggcttcagtttcttaatctttaatgactgagatgtttttcacaaattcctgatcagatgctaattcattactgtctatagactaaatgtattaatcaaaagttcaacacaagaagaattcataagaaattttaaccacttataactggaaataagacagactaacaaaacctaagacaaaaatggcagtggctggtcatcatcagccaaaaggaaaaactaggattggagaggttttagaggtgaagaactctagtcctcaggaatactgccattgggaaaagtgtgtttccattttcagacaaatacagcaaaatatcaaactttcattgtctgtggtcagcaaaaagccgtaacagtctctagaagaatcataattttaagctttgtgtgtcccggcttcaatccctcatgcgtagttagacttagtcttaagttctcccagtaacttcaatttgatggcctatttttcactccctggcatgcactgctatatactcttgccatatatgatcctatggcctcctctattacaatgacagaaactatagaatcttttttttttttttctttttttgagacagggccttgctctgtcacccaggctggagtgcagtggtgtaatcatagctcactgtaaccttgaattcctgggctcaagtgatcctccagccccagcctcttgagtagttgggactacaggcatgagccaccatgcctggctaattaaaaaaaaaaattgtagagacggtatctccccatgttgcccaggctggtctcaaattcttggtctcaagtgatcctcccacctcagcctgccaaagtgttgggtttacaggtgtgagccaccatgcccagcccagaataacttctttaaaataattaccggtacttgtacatgaatgttcatagctgcattatccataacagacaataagtagaaatagcccaaatgtccatcaagtaatgaatagattaaaaaatgtggtatatccatacaatgaaatgttactcagcattaaagaaagaatgaaatactaatacgggctataatatagataccattttaaaagattacgctatgtgaaagaagccagtcacaaaagactttatattgtattatttcatttacattaacagtccagaataagcaaatccatagagacagaaagtagatcagggattgtctactgctagggctgaaaagagtagttgcaggagaaacgaggagtgacttgaaaatggggatgggatttcttttggggggtgataaaaatgttctaaaattgtgcgctgatggttgcacaactctgtaattaataaccagtgattactaatactggttaacctattaactaataatcagtgactaatacactgtaaatgggtaactcctatggtacgagaattatatctcaataaaggtcttataaaaaactaagttctagattcaaaattttatttcttatagcacaaaagatattaccccagtgaaaacaataaaatcttataatgctttctcctactatggaaaaatcaaggtttaacccatgtacataaaagaaaaatggtatgcacatgtcttcagaattatccgtgtggacattaaatattttcagatgatgagttttaaaaagagtccaaaaataagcccagaaaatgcttaagtctgggttagcctaaacaacttggatggtttcagtctaatggaaaatgacatcacaaactaaacaggtatattaagggattttgggaaagaaaataatgtaagaaatgagaaaaacaagggagatacctgaaaatcaaccccaaaaacccatcaagtaacagaaaaactccaaaggatatttacccattcatttttatgacacatttatgtacccagtgctgtggagataaagatatatgtaggacactgtcccttacccttgaagagctcacattctagagtgtgggatattgtttacttccaccatggaaacaaaccttactcgaaggcaaaaagactgggaatcatgctcactgctaaagctaaaaatacagatttttatctttgaaattatcgccttgatttaccaggaaattacaggaaaagaatcatatggatttacttatgacttgtagttacaacagacagactagcaccataaggtaactcagaatttggagacacaagaaaaggtcatattttaactattaagatagtaaaaaaataaaatgggtgagtttagccatctgcagaagccatccatgtacatatgtaataccaacaggaaaccatttctaactgggctgctcatgcccaattacaatcaagtacatcaggaggtccttggtcttcttcttacacaaactctcttcctaggaggtctctgtcctctccccaggcttccatctccgccacaaccatgaccccttcccgcaactcattactccttaatcaagacttctcttctaaggcttcagacctatctctccaacattctcctggatggctccattagccatgggctctagaagctgaaacttgctaagcaccaagccacacgaggttgatatactgattatgcaagctctaaaatttcagtgccaggaaaggaacagccttcctcaagtagcattacacaggaccatatagtagctacacatctttgtaacttataccttaatcttactttgagatgaaagctatacctgcatttctgtcataagataaagagggagaaatatcttcccatgtgttgatgatacactttaaaatcacaatccaggagaggcctcaagcaacaactggcctttgcatctaactacttacaaagaaagattccacagtaattgtgatgaagctaaaggtgctgtctttggtaaacatctttcaaagttcaatcatttcacaagaaagaactcccgatagcaagttaattgcatcaagtcactggtggcaatttttcttggtggtttgggtgaaaagccaagttattcggtgggatattctacaaaaatggtgcaaagaattttctatgatcatgagagttaatttaatacctatctttagatttttcagactaaatcattctggcttctgggtctacagggtaactgcttcaccactagagcatatgaaaagttacttttgtgcgaaaaatccaggcttcctacgtgggcacctgttatagctttatcttctgatgttcccagagacacaacggataggcttctcaacaactacagtagagagtcaactatgctatctcctagactggttttcaaagtttacttcagacttgaatttctttaccaaagtgtgttccatataacattgcagttgggctcgaggtcaagtaagtgggagcaacatgaggttagacaaagctaatcaggtttcttcacttccaaactcctcagtgcaaatgctaacgtaatgatgactttccagtatgagtgctttcaaagttttactgtccttggaatcctttttttctcagagtatctcagtggtattctgcagaatacattttaggcaacagtgacctttatccttggagaactgtcaccctatctttggtgttttaatgttaagctttccacaattatcaaaggccatgagaaacagccacatataatttcccttgggatttgttataaaaatgttgataaggacactagccaataatcacttcaagtgtaacgctgcttaagagttcaggaccaccacccaagtttgaatacaggtcctattacttgctggccatatgaagtgtccttaatactctgtgccacgtaatcctctggaaacagcctctctttcatagggttgttttaaggattaaataggagttcatatgtactcagaacagttcctgtccatagcaatcactcaaaggacagctatttttgttattattattattacgtagagccaggaaaacaatgatgtttctttaggatgctgcgtgcttctttaattcaatattaagagacagacaaatctttgtttcctattatctccctggctacagggaagctcaaactgaatctgaagcttagtcaaatcaactatgctaatccctatgatgttcattgatctattatttatattgcaggaattgtattgctatgactttttaaagaatcctttctgaaaactgaatacgtaaaatcaacataggaaatttccacttgaaatgtccttgggcaaatagaattcagtatgtctgatacgtagctctttctctccatgcactaaccctttgcaaatcaggagtttttcctgggtgcactaggttgcttttgtttgtttttcaatgatcatttcccagttcccaaattaaaactttccgtaacaccagatgcctccccctctccattttcccttggtctcattcattcagtgaccttctaatttctccatccccttcttcacttgcctaagacatccttagttaagaacctggcatcttttaatggactattccactgtgcttctaccaatcttcatggctttagctttctgccaggtcagttatttttctcaatcctcccccccgtcaaaaagccatcactgttcacctgcttataggataaaacccaaactccttagtatgatgcacaaagtcctttaaacagtagtccccacctaccatcccactgccctcttattctcctcattccaagccacacattactcactggtccaccagtctggaaaactcatccttcccccatctctcagactggaaaactcccattcagtcttcaactcttaaactctctttgtaaaggcctctctactccctctgatagaataaatcattcacctctgtgcccccagagcacttgtaacagtaggatataagtagttgtttctattttaacttttttaaaataaattttgagctccatgagggtaagaaccaaggcttattcatctttgtagtctcataattttaaaattacattaagcactcagtaactatctgcagaattgaacagaattacatcctcaggcctggaaagtagctaaagaaactcatgaccataatcaattctactgtagagggacaattggcaaatgaaggccaacaggaggatgagggtcttcatgaaaaatctaaaaaaaaaaaaaaaaaaaaaagggaaattggattgtaagaacataaactcttatccagcatgttctagggagatggcagctgtacttgtaagatgtgaatattctaatcgccagaggggtgcttcaatttttttgtagtatgaagcagtcctcacaaacatccaattttagatgccaagattctaggctcaccagaacacaatttgatttttattgtgattcctaagacactggattctaagacacaggatgctgtgtgccgaaaaaatgaatatattcctcattttaatagatctagtatttgcacttaaaccagatgctgtctcctcctaaaaaagctttaaggcaaccttgataacattttaatacaaggcagttaaaaagagagataattaggataaagggagaaataaactttcattctgggttatccattcactgccatgaactgcatactatgaatcagtcccctcagacttcaattaactttggataaactgaaggaaatttagttacactggccctgctagttagaaactgagtctgtgaataatggtgattccacttctaccatgttcctgtcctccctgcctgagtagagctgagatggttgaccccattcttacacagcttcttaaatgtggcatgtatgcccttcagctcttattcatccttgccataaaaggtcttggctttctgatttctgtgatcaaactagctccctttgtctcaagaagggctctgtagccctttgttttggggcccatgtcaccaaatgatatagtttggctggatctccacccaaatctgatcttgaattatagctctcataatccgcacatatcatgggaggaacccagtgggaggtaactgaatcatgggggtggggttttcccatgctgtttttgtgatagtaactctcatgagatctgatggttttaaaaagggcagttctcctgcacatgctctcttgcctgccaccgtgtaagacatgcctttcctcctccttcaccttctgccatgattgtgaggccttcccagccacacggaactgtgagtccattaaacctctttttctttgtaaattgccccgtatgaaaatggactaatacaccaagtaacttgaatgcctagtttcgttaaatgtatcatataccacgctttcctctccactccaactttaaaaacatgtgggaacagccgtaggaatcagtcttgaattatttccagtgatgtctactggacattttaacattcattccattatgcttctttcctcccttccttaccctaaattccttacctaccactttgtcttcagaggcagtccttcctctcattcaaggtcacgcctcctcccatactttagttccctaacccttctctctcctgcctcctgtgggaaaatgctcccatcattcccaagctctgccctcctcttcttctggcacatttctccagcatgtgaaaattagagatttttaagtaaaaagagaaaaccagagtgaacactgcacgacactgtgtgaagtaaccccaacaaccataaatatgtttgcaaatatttgcatatgtagagagcatgtttggaaggaaacacaagaaaccaagaaagatggcagcctccagagctggaaacaccacagccaggggagaaggttggagaaggattcacttttctctatatgtctttttgaaccctttggattttgtataataatatacatgtattctctactaaaaataaaagtaattaaatacacactttaatgttcacatcttccggagttctaccaaatccagtgttctccttctgctacatgctcccgggatatataaattcattctcacggtttcaactaccacctgtgagctggcgactcacagtcctaatatctcaggcttatatcctttctacaagcatcagagttctatctctcagactgtcagacatttacacatggagatgtcaccaggacctcaactcgacctcttccatacctcatttatcaccttccagctactcagcccttcaggaaggacctctaataaacactgctgcattaaaggatggacctgctgcaactcctcctgaattatcagtcccagctgcaaataactactatcatcttgttttgtagttaccagccctgggaatcattccttcataccctagtcccacagaactaccgaatcaaacagctctatcctcccccgaaatatcactcagatcagcctgtctacttcatttctatcaccttacttaaggctctaatcatctctttcctgggctcccatgtgactccccccagcttgatttcctcgttccagcatcgctcttttcaaagttaccctccgcacagctgcctgtgtggcgtatattcatgtcaatatcatggcctgactcctggatcacacccttgagttgctccctagactaggcacggaggcagcaactctgcagtgggtaccacacccttcccgacctgcccttgctgacctggtcagcctcatctcctctcattctttgccttcttaaaaaaggtaatacaactgcagtttccctcaaacaaactctgccattcctcaccctgacacctttgtttatattccataggaatgcccattcctaacctcttcagattcccttcattttggccatcttttcaccatcattggagacttgcacaaagacctaatgaaagaacattgaataaagatttcccgtagctatgaagattgatagctactagactaggtccaaagtcatcaagtcaattacaaagtaaagcaacgggatcatgatttccagctactttaattcagtggtatcagtaactgatctagaacttctttgactgtaacaataataatcttgcacaatcactggaggaatttaaaggaaaaagagaaaactcaaattttggcttcataaggtcttactgcccaacaagacatatgaaaggtcctgagtaggtattaagaatctacagagttccctcgtgttatataacatctactaacaactttaactttagactttatggtgaattaggttaatatttagccaccttgttgacttgagaacaatctaatcaatttgctctgcaggtagtagaacgacaatgtctttgtctctcagaaaggctaccttttcattgctaggatcataccttgaatttcagagcaagtcttggtttatttagacagtgcagagacaaatacatctctgtatttgaacactacaggcttaagtcaggagactgaaggctttaatcaacgcaagaaaaaaaagtaaaccttgagtctgcaatgctaaggacacacaatggggcaaaaacccaagatccagtggctctttgccaaataaagatgtatctgaattatatgtggtaatgagggagaaatatgatgcagaagcgaaatattaaagattagatatctcactaacaccattagtcatccaaacttatgggaggcactatgggaaaaactcagtcagatttagcttttactcagagctttagccttatctctgtggcatcaaccaagaatcagagaacaccaatgtgggatacatacagtgcctgtgatttggaaaacgggttcttaacattctaaatttatgacaaagccatgcctggtgctaatcaaggcagtttgaaaaaggggagaattttgaaaagcaagcagaaaacaaagtctttgaaaggcttttctctacgaaattaggtttgtaaaagaactttagtcaaaagtgcatgcatgtatgctacaattaaaataaattcagcttcaattcatttattcattaatgcattcaacaaatatttattgaatactatgtgcaacaaccaggagaaatggaattctaaaggcagagataagatacctctgagacacttctcaaacagccatcctctgtttttctagggggttgtagggaggtgtcatgaataagaacaattaatggaatttaataaatatctagtcaggaatggggctctccaggcctctctcttttgctgttatttggagataaatcacagctaaaggaacataaaatatatatattaacagatcaataagtacacatccaaaggacttggggcaatctcaattttaaatatactttcttattttctctaaaagtatgctcgtatttgtcagattgcgtagcccaatgctgacttaggacatagccagctagacatgcacagagagggcatctaaagaattcctgggttttctcaacaggaaatggcaaattaaaggctccttaagcaacactgaattcaagggtagcgaaggcaaatctagggctctgaagctccttgcgcagaactgcaagaagacaggacagggcagatcaaagaaaacacacgggctgttttcaggaagggaactctgtggagacatttctttggaatttggtagaaggtcaaataggacaaaatgaagggacaatgaaggaagctcatcctgatcatttcgtgaaggtcaaggtaacttacacaaagatttgcatcaaccccagagtcctcattttggagctctaagtaggcctggtgttatgttttttgttcttttagagaacaaaccatcccattcttggagaatggtcttggatatcttccagggtaaagcggttatcgctgtgccacaagtagatgaacaggtttattccgggacactcagtcctcatagatagtccctcaagttaaggcacattctggggaatatgccgcaattctatgtaaatgacattcacagagacttactcttctttattatctggttgaaggcagagttgcctatttagagtcagaaaaatctggatttcaattcagttctaccactggctgactgggaaatctggggcaagctgtgtgaacctctaagaacctgtgtctcattcacagaaaggcgacagtctcttctccatagcgtttgtaagaagattaaatgatctaaaatatgtaaaagtgcactcaaaatgataaaatgataaataaatgatagttatcagtactctttacaaacattctttgacccgggtgcaatggtacggagaaagactatgctaaccacaaacgaggcagggctcttgaccaatgagctcaaaagatatattacacgatcatatacttcaaaaatatatttactccttggtaacatcaaattctatttacagtgtcagttccaactttttattccgatttgactttgacccctacaataattacagatttaacataaatggatattactgattattctcaataaagtagaaatgttttctctaccatggtcttcactgacaaatgatctcaaaagtacggccaaaaataaagctatcattaaaacaacaaaaaaagttcaatattatctcgtggatggtactcatgtgatgttcttgctgtattttcaggtttttagcaaacatttcctgagtagccattaaatattcaaaccatgctaagtactctggaggatatgaagatgattaagatacagtccatgccccaaagacacacactagctcattaaagagaggcactggtaataactgataaaaaggaaaactgtcaaggaattttctgagaaaggtccaaagtgctctgggaatagaggcaaaagacagatttcttccaactgcagggatctagcagggctccatggggaaagttattttgagcagtgtgatggaggataggtgggattcctttgtcagatacggcagtggtgggttagaggttagcagttaggctgagactcaagcttgagcttgaccccaaaggtagatgagagcaggatgtattcagaaatactagctacaacagcatagccagaacacagggagaacaaaagaagatggcatagaaaaagcaagtcaagagaatattgtggaagggtttgaacgccccactaagaagcttgatttttttctacatgcagaaatccagtgaaaggggaatgccatgatgggtcttggttctggcaagatgtacaagtagagtcagtatggaggatttattgcaagggtgggaaagagactaaagggaagccaaccagataaggagctatggccataggtaaaaggtgttaagagctagaaggctcgcagtggcagcaggaagcaatggaagagtggcagtttgttttttcatcctgaagtggcatactcccgagggcactgatctcagacacactgcgttgcctacgttaagagcttttggtgccttgggctcaaccaaagagatgaaagtacttaagacccacaaatctgagcaacatctactttaaatccttgcttggtggcatctgtctgaagaaggcacattgtgagttagaagtgatcatgtgagaagactttttaaaccaagggacctgtgacataataaatgtaatacagaactgaaagtccaatgatttgcattatcctgacacaatacagtaccccagatgtttacatctttgtcctccctgcagtcattatgagagttctttagcctttttctcttctacaatttctgctatttttacatgactgtcttttacaggtgatggctgacaattggaattgtctcactaacctgctatgatggtgagcataaataataatttctgcatttgatgatgaaaaataagatgaaacaattggtttcccaatatgaccaagccaataaccctactttcttaaatgtttgaggtagataatatggccaaacacatgtaaaaaaaatcatataatcataaaattaaataacctacttttttcttaaattctattctgaaatataaaatcaaagccttggagacacatgcaacaagtcaaataccaccatcagcattaactccttcacacctaaaatatgagttcttcatcatactattgcatccattgtcttctttcagataacaaaaaaaaaaaagagagagagaatctgcaaatggagctaaacagattattttagaaaacaattagacataaaatgactctaagtgaagattcctggcacttttctatgtgtgcaagtgtatgcactctgcataccaatgacaaagctagaaagaaaactcacctgttttcttcctcaagatctgctaggattctctctagctcccctctttcctcactctctaaggaaatcaagatctgggcaggactacgaggctggctcaggggggagtcctggttcaaactttggcagtaatgctggattaacaaatgttcatcatctctggaaaataaaatcaaaggttttggttttttcccccccttattttgctttgggggttagggactcaggagtgtatttgaaaatagaaacatttatttgctcttaacaattaattagaccttttttcctgcttctaaagaccttttgatactgctgaggttgtgatctaccattctactggtaccaattcaaagtgttttcttgctcagattttcaaatgaaattgattggcctatttacacggataaatgaaaggcagaattacagaaatactgggactctacgttgatgttagtcaatagctaaaaaatattaaaagatataataatggctgtataatgctttggccaccaagcctgtcaagataatctgttcactaacccacgctattgttgtactgagtaggaaaaaataccttgcagctctaaaagtaacagaggaaatattttattaagtggaaggcaatgtaaccaaaaagtattgcttcagtaagtcagttttaacttatataagtcattgaggcagaatgacaacaacaattaaactggagatacatgattgtttcattcagttattgtttagacagaagaacgaaaattaaggggaaaaaagacattaaggtgactgattaaaagaagactgaacatctcattcctcggggcagagtttttttaaatacaagttttatttatttttaaatttatacataatggttttaaggactaatcttgcgggaaaaggaggcaaaaaggcttctatttggggaggcagctacaatctttcctggaaactaggaactctctaatacacaggacaaacttttttctgaatgcattgctccaagctccggaaaggcctgtttacctccaagttataagaattttcttctgtccgtaatgacaggctaaagctcattgtttctggttagatatcattaagatgatacgctaatattctcctctccatacccacttaagttgaaaaatatcagaaatttaggaaaaagtccttctcatttgaattatttttgtttatcaagccagttacctggtttagatgtgaaaagctgactaaaaataattattgggtattaaaaacacacatttaagtgaagtcaaccaatccaccaaaccacttccccaaacctgcccctaaaatgccatgagtttttgccatccaacattgagtcaaaatggattttatgtcctcagaataagctaaagcttattttaaaataaaacaaaagcagttttaccacctaatttatcacactcattccaaattctgaagttgtactgctagaacttcccatgtttaattataacctagagttgtaactacacttttcttcctgttctcttaggcagtcaatgaatgacagccactgttacgtagatacaactcgaattaatctgaatgtgctagagcttctaataccaaaatcagtgagccaaagaagcacaagctatttacatttggctgattctttggccacacattttactgttgaagtatcttatatattagtaccattaatactttttcccatagctaagaaagataaggcatcacagttatggttggggaaaggcttttttgtttgtttgtttgaaggaagtaagtcatatacaaatgactgagggttgacttgattctttattattagcttgatcgtttatgtaccagatgagattatttattctcatgtcttcaataactagttatatatatgccactttgatactatttcttttggcctaatccttatgaaggttcttttctcatctgagcatgactttgtgttgccacaccaactacatatgataaatttaccattcttccctttgtctatattctccaagatgggtgagatatccttactttatcaaactaaaaaggcatcgtaatactttgactagatttcttctctttatgttatttattcacttggcaaatccttattttttccttcatatttgcttcaatgtctgctctctctacctcaagccccggtcagcatttacttggttcatggcaatgttcctttgtgctctgtattgtgaacactgccctcactctataatgaagcctgtttccctgccatagctgtgttccctgctgctcttagcaccgctctatctccgtccttaaagtttaacagggttggcttatcatcctgctaacaacctgcaacctgaattggtacttctcctctggaaactcttcataagattgcctcactttatttatcttgtgaagatgctaaatcacaaaaatctacttctttggatttctgaaggaaaatgcccaactaacctaccatatgtgaatagccatgctataccaagatcacgtttccactccccatgagtggagaaaatagtacttagccatgactttaaaattaatatcctatccctttaaatatctggcaggtttggtcaaagattaagcattactataaatacttgggactctgcaatttgtaatcatatggtatgaaataagttcaaataagagtaaggcaaactatttttgctactctgaatactaataatgccagaatttggatgagctcattccatgccagggcattaagaattaaaggaaaaaagtaaatgaatggctccttaaaagatcaaatgaatatgatgctaattcctatatcctgtgctatcctacctctaaatccctcaaagcaatttcattgtcaggaacattttgtaaaaagagatgggatacttacatgctctcattaggagagatgctatcatttagataagatccattgctgttttccatttctgctagcctgataaaaaacgtaaaagctcattaaaacttatgtgacgtcttagaatctattcaagacctaatcgaacattcctgaaaactaaaggataaatcatggcaagaagagaaaggaatccttcaaattaaaggatgtgtgtgttggcttaaccatttgaggcagtgtgtggtagaccacagctagttagtagcactacatttatgatagaaattctaaggaaagttatatttcactgttttccccctacagatcagtcttgctttcactgagaacaggtctttgttttcagaagaaaagcttccctaacaataagtgcactccctaccttacactaccccttgtcttttaggacaattactactttccactgatgacagacttacacagctagctaatgcttttcacgattggtaaacatgtccagcagttagaatattgacaaaggatggatgcacagtaagctctctaaacattctgccaccaatttttacctttaaaatcttcttcacctcaggcaattatacagggggttttttgtttgtttgtttgtttgtttttttacaactaaaaaagttaaccaaactcttacggatttaacaagcataaaatattttaaaattagtaattcagtttttaggtataaaaatcatctcaaacacaaagaaggtgagacagaaaagtccaaggattaggaaaattaattattctcttctttacagcatatcatgtaaaataaatacacaaacggaaagctgatgctttcatattctccatataatatagtatcattttttcatatatgaatgtctggtctagcagttttctaaggaggttaaactatttgtaagccaatttagtaaatgtgctcagtataaaaaaacatagcaaggctaccggaaatgtttaaaagccagggttagggaagattattctggactaatgctcttgttggtgaccaaaaacaacatgcagtggaacggcatgcacgttagagggcaagttgattagtaggaatcagacaagtttggggaaaaaaagaaaagatttgtttaaaatatcataggttagctttccttggttagttatttcaatcaatatttgcctggcatacaactagtctcatacctgctagcataatgttcaatgcgtgaatgagtatcatcgtgtgaaagctgaggggacgaggcaggcctataaggcagaaaatgtgattagtcacagataccatccattaatggagaaaaaacccaccacacagttatgttatacacatggcctagaatgcttttattctaattctatggataatgtatacatttagttgctcctatatcttaaatattatcaagtattttaaaatccaggattgagagatgatttctcatacttctgcttttattaaaagccatgaagagaggccaaaatcttctctggaaaattcccatcgtagaaaaggttgggggagacagtttctaggaagcattttgtcctcctactttgtaatttctcacatcctataattccgaaattgtgttagccctatgtggtttaaaattttaaatagtttacacctgcgccatttataggctatcttcttattggatcaaagctgtatatctgcctagatacttacaattattttagcttcaaagaggctactctagtacaagacttcttaaaactccatgtatcaagatgtcttgatctatgcaattttgtaaagaagaaatgtatcttccaattcagcagcaagactataccactaatttctagcacaaaatagaatgaccctggattatattgtgaggttttaaaaaagaatgactaaatttcatagaacgtcatgatatctgaaatatttcttagagatactgtgtgctaaaacataggtgagaaaataagaggagatcattagcaggaatagtctatatgctttttgtatataaacacctatcttttcttatctccataggctagaattctggtagggttaacattttttcatcctttcatatctgatctattaattatccttgaagtttttatagtatcttttggattaaccttaggaaaaaaaaccatctgttctgaaaaccagtttaggcttggactttttcttttaattggaatagcacaaaaggtctcttccatttctctgctgacacagaaagcccttaggtaaaggcataaatccaaaagtcaacgataatgtaattcagagaggaccctggtttagcccagtgtccaagtagcgttgaaggacttggttgaaacactaaggagaatgtgtttgtttcttcttacattaaaaaagaaaaagatgcagttaccagtagctaagcttgcattagaaaatgtgccagaaattcatatttcttaatatactacagtaagataattacgacacactatagcaaataactagggaaatggaattcttccctgagagagaaaggtcttatttatgaaaccaatgtcatctaggtcaagtgtaatcataatcaaattgaaatgagttataaagacgtttaaattgtcaagaggaaacaaaacgatgactactcaatttaataagcagatccaaagatttccatgtgaaacttcactatagttttggagagttaatctgttaatcttctagaaccctggcatagcccattattagaaaaatgctaaggtctgttttgaaatcttcactgcagatcaagataaattaatacttggattatttgtattataagaactatcttttggaacagaccagtctttcaattacatatttttttaataagcaaaaagcctaccatcagggaaaatacattagtagtgttttcccttgtaatagttgctatcctggaagtgtgtacaagaatgaaagcctaagaccttggagcataagtacaccaagaaaagtaggcatataaatccaaaatactttaataccattttatacagaaaatcttatacagagctttaattctttgcctcaaggataattccatgttatttttcttattaatatcagtggcgcctatcacagcatgcataagcacaagaacttacaataaccagaaatcttaaaaaatatacactaaaagagacatttattaaaccagaaaatgagccaaaagggagtactggtcagagatgaatcatttaaaaaccaagaattagtgaaaatacaaagccacttagtccacaaacaaaactaagtgcaaagccttctaaaacacttccaaaagaaggtaataatactgttccccgcttcccacttcctaaacacaaaaccatatacccagaaggattacttactataagagttaatgacctacttggtcaattccatcccacccaccaccaccttctcttttatgaaaactctattaattaaaagctgacattcatttaggtttcaatgcagaatcgctcaaagaatatcgtttgactggctcacttatggacagacaacgtaaaggcctatgttagctttagttttaaagtaatatgacaaacacaagcaaataagagtttagtctaaggaaaaccaaacggtctgtatctctggaaactttcaaattctgtgatccatatcaaatggatcaaatattgtaatcatcataggatttgttaacattagatacaagtcttgcaaaatgaaacacgttaggacctggctcttatgcctgaataggatggctttgtaatatattttatacagtatttataatcctatgaataaatactttaaatacaattactgctattaaagaaaacacagacttcagtctgctagatttgttttcttcctcaaaattaaaacttcccactatttctgaataatctaaccaactcttcataaaaaggcaaattgggaggtgtgttttagttgttagaaaatatttttaaataaaagatgttattaattttaaagtctttcaacgtttaagacagacaaaatcttctacttaaaataagttaatctgattgtcataatgtttttctcattagcttacgtgtagctcctttttgcctttcaaggactattaattactctttgtttattatttggtgctacttttatctatgtatttgtaacaactgttctttagcatatttgtcgtttggatttcttactcggttaaacttatttccacatagagtaaatccattcccttatcaggatccaatcaagctgaaactgtagtgtatcaactctttaaaagtttcttatttatgaacggttgtaacttctataacagactacctgggttaggaaacacaatttccaagaggcagaggacataactgaacctaaataactccctaagttctttaagcatgatgattaaataaatcagataatatactacttatagctaccatatctcaaaattaaggggcgcaataacgaagttttaaaaaggaaagcatagccttccacttcctttaggcctattaaagactgaaaataaacctcaattaataatatgcatttatcacgacagggtttttaaaaaaggatctagtttagattaaattatatggtggaacaataaaaaagatttaataaaaagaaattgaattcttacacaagcttatcttccgaattggtcatttcccctttatccataacagagctgtctgattttcaataaatattttaataaagcatactttgaaataccaaaagtttgttataacaaccctacataatgtagttttaaaataggcactttgtttgctaatatagaaatcacaggccccaaaaaagagttttctagcattataaactctgagataaatcatctgctggtatctaagctcagtattattaatacacaccaatagtaataacaaagaaatactttcctcctagagcaaatgtataattgtttatgagctgaatatttagcttggagaggagagcaaagtgagtttagttcaaaatttagaaacccttgtatataatgattagtcaaatagcatggcataacctgataaacagtccgcacacctcattaaaattattcaaccaaactcagcatcatactttaaaacgaattctgctgatttttaatagtccacttataacagaccctaaagattctaaaaagcatcgaatctcaagaaatatggctaaagaatgttattatgtaatcagaagcttcttccttgcttttatatgaagaaatatataaacatgtctcccaggaatacagctaaaactccaataacttctttgattataatttgaattcaagccaggatttctgctggtttgaatttcacctggtggaggaaccaaaaaacccactctgattctcctgatctgtgtagatggtactttcaaagtctcatcaagaaaagaaaaaaaaaaactgaaatgaaggaaggggaattaatatgtccataaaacaaaacaaaacaaaagaaaacaaacaaataaacagaacaaaagagaaccaagcgagcgaatgtgttggtggtagcagcacccttcagcaaaaaaagtactcacgcagaatctactggccagaagttgatcagagtaacgggactgcaaaacaaaaaatgaggtggtgaaggagacacacgcaaactcagccgcaaaaaaatttactgaaaggtcaaaataaataaaatccagccaattaagtatgaaccatggaaagcaatagccaaaccaaggtgtaaagtgaattaaaagaaaaacacacagttgtgtgactgccatcagagttaaggcaaaaaagaggagcaggttgaaaagaggtgaagacgtcccctttgatcttgagaatcattactacttactgtgaagtagtttcctgtgactatattttcttttgagtagaaacaagtgactagatatgaccacacaatgagatacaaaaagacacacatttactgatttgtgagagaggaaaatcaaaatgaaatactggaatcactcatttgtaaacagtcccatatttcttataaggcttgtaaggcaattagtggctgtattgtgttgtggtttttttttttttttccccctgtgagataaagtttaacttttggaaaaagaaattgtcaagtgacgtgggaaagtggcaactggacatcagcttatttttctcttttcagctaatgtaaataaaaagaaagaaatagaagagactgtttgcatttgggagtgaaggagggtgttcagctgagaggagttcaaatatacatcaaacaagagtgtgttctgcttttgctactactcacgtttccatgttgtccccctctaagacagtctgcactggcaggtagcccattcggggatgcttcgcaaaataccttttggttcgaaatttgttttttagtaccttggcaaagtctcgaacatcttctcctgatgtagtctaaaagggagatcatggtgagatcagatttaggacaggatgatttcaaaactaatgaccactccagtcttctgccccatgacacttgttttgtaattaaggagagtgttgtggttgtgagcaaaggctttggaatcagacaaatggggctctgaaaccaggcctggcatgtactaatttggctgagttatttacttctcagaggctctgatcatcagtaaaatgggagcaacaacacctcaacacgttgttatgataaataaaagaaacatacaagcttactaggctactcaataaatggtagtttataggtcttaaggtcaaaaaggtgacattaaattttaccacactttatggtattttaaaaactacttagtacaaaatgatagcatgcttcacccactaaatttcggtctattcatagcatggtacattctcaatcactgaccatctctataagaggaataaaagtgagacaggcaaatatctgggaggatcactctgatgatggaagagagagatgctctaaagcagagcttctcatactttgttgtgtatgggaaccagctgcagatctcgctaaaatgtgggttttgatttagagcatcaggagttggggcctgtggtttcacatttctaataaagaccaaggtaatgccaatagacatatgatgattagtcaacagaccgtatcttgaatagcaagcatgcaaagtttagagaagaggagactgtaagaattaaagaaagagaagagaaacacgaagggtggctctacagtcaacagggacaggtttattttagaaaaaacaaacctgagaggagcctgtctttaattcttaggcagatttgtactcaggtctgtctggccaccaagtctacatccttgccatttccctagtgatttttcacagttctattggccacttaacattttcctaaaataacatcttaggagatggcttcaactcttacttatagaaccttgagtaaattatttaacctcaggacctcagggtcctcatctgtatagaggggataaaaatcatagtacttattttacacagggtagtttaaaaggtaaatgcctagcatttagtaagtgttagcatataaaatggatttttaaaatgtcactagtatacaggacagataataggtgagcaacattgattaaaagtggtagtttatgaatttgggggaacctagaaccatcccccatactcaacatgcctcatggccataagatcgccccacacaacctctaaggctgtgcaaaataaacgtgaaaacgtcttcaatacaaccatgcacacagaatgaaaaccctatttattcatccaacaatatttattgagggtctatcatgttccatatgtgccaggcactcccctaggcaccagggatagggtaaatcctgaagcctacagttgagagccactttagctggggaacatctggggaagtgacaaatcacagcattatacatgatctgcagtattgtacaaaactgaaatttatcccaggtgaactaactctcacgtcaggctggcgtcaaacttaccggagtgcaatattccaccatgggatagtgcattttatggccttttgcaactcgaccagaaaaaaagcagctttggcagatgtcataattaaagtgctttagactcctgtacctgataaagagcaaaaacaaacacgtatgtatttcttcgaatcaaattcccaaagaacactctttaataaaccttctaccacgttctaatttgagaaacagaaagcaatgttcattagtcccacaaggtaagtgattaactttctgcctccagatttttccggtgcctctcctacagtaccaaaacattttggcagaaagattatcctataaacatatggaaggagggaagaaaaactcagcttttatttaaactccactaggaactctttgagattaagtaggaaggtactggaaaatttccagtcttttgaaaaccaaatactcaaatttaaaagaacttccaggagcgacagacttacgctgtgcatgccccttacccatcatgggacaaaagttttctgaagcaattattttcaaaacattgtcaagataaagcaatttcacaagacaaaagaaatgtgaacaagaactttcaattaaaacaagtctcgctttaataatgttttctaattgactgatacgattcatcttcaaacagttactcgaatgaactcttttatctctatctcttcagaaatctctcaccccattacctacaaatgataactgaagccccaagagaacatgaaatttggattagatggaagaatttataatctgtaaatactagttggtacatttcctccattatcagaatgcgatattctttgtttcatactctcctgccttttgctttctcagataagaaccttagccaattcaaataaacatatttcttatgtcacatatggggaagtgggaaggaaagctatcttttttagattccagccatctttcaagagggggacaggaggaatgagaagtgctgggtcctaaaataatataatatgataagggcaaaagaattgaaggtgaaagtgctctttcagatcctccaaggcattcttcttctttattttataaaaatttcccttgtatacaaagcccactagctaaggaagcagagaaaaggtagcttagaaatctaatgcagtcactgtggcttcccttccccactccccacccccatggtatcatttttacctgccaagaaaccgggaaggaaagaaggtgacctttgcaagcagtacctactcactgttgtctatctaggcttcagaaacctctaaaagtttttgtaaaacctctttgtaaacagcatgactatggaacaataaacaccaaaagtaaaaaagcactatgaataaaaagcacgcaacagtacaaggtagttattagaaaataaagtaacaaaaccagttcacacgtaactggaaaagagtgtttactttgctgctaagtggattctgcacaggcatagaccatagagctagtttacaactttgtggcttattcatcactatagaaaccttgatgttgattcacacatttaaggacatcgcagtttcagaattaggatttaggattaatgttaagtgagattaattcatttaaaaaaaaatcctgtctccccaaacaggtcagcagggctaaagatttatttggccttgttttccatgatattttaagactatcagaataacctgctacgtttcctatctctttcacttctaaatgtataaggactggttgttttttagctgctttgtgaatcttccatttacttgcctactttttattcctttagaagttcactgggatactatacaaagaatgtaatcagattcacagataaagaagcaagttctaagatgctgaaaacaattcttgttacttaagggagaaaaaaaaatggtgcaaagtgaatgagagactgagctactattatggttcctcccagaatagaatcatctctcagttttataactgattcttgggaagtttctataaacaggaaagaccgtgaaaaaggaaagatggtaaaaatgttttggttccaggaaggaggaggtacagttcatctgtaatacctccgtgaagacacgcactttggcctgctcaaccaaaaatgtggctccgaagagctgaagagtgaaggtggtaagggacaccagcctaataagtgagatccaccaaaataacctagcgatcaggagggtgacaggaatgatcgatgttccagcccaatcaccttctctcccactttggagacggtacgaactaacagcaactggcacaggagataaaagatcaagtcataaaaaggtgaaaaatgatgagaaaaaaatgacattttttttttggttcctaatacctgaatccaatgattggacactctttgcagatgttacatttggcctgatgcttggcagtttctgcagcagccactctgtgcaggacgggcagccacaccatggactggggttccagtctcatccagtctaggaagagggccgcttcgatctctggcttattattagcctgcaaagacaggagggagagagaaggagggcaaaaggatgaaaggaaagaaggcaagatggcaaaggaggtgtatatcagttcgattaataagttaaacagaaaagatagaaagaacaatggttgcaaagctaggctggcttttcacagcttgtttctgcaaatgctccctgatatccaaagagctacccactcctaaggctttggtaaactgccattactctttttggctactagatgacaagaaaagaaaacaaaaccaacaaacgagaaaggtaagcaaactacacacctgagcgagactttatttagctttaatttttgaactgatacataaaagttagccagaagtgaaatgcaggtgtttactgataaaatttcaaaggagggggacaactgatttttttttctagagaatctgtttctcatagaatcataatgaggggctttaaaattcatctggttccaaagcctcatctaacagacaagcaaactgattttgtagaccagaaaaggagcttttcaaaggccatacagctagcagcagagctgataatagaatccaaacctcctggcttagcgctgttttcatgatgccctgttgattctgtctgcctctctatttctctctctttcaaagtctaaatgtaagaaatacaattcatcccagacaggacaatgatctcaacaatctcaaaataccaccatttgatttatatgttactatattcatgaattttaattataccttgtttttttcaaccctataggattgttttaattttttatattattagatagattgacctatatattgactacttttttgctcttcattgctttctttcatctcaaatcttccatctgggattagttctgcctgaaatatgtcccttagaatttcctttagctgttggtggtgcatttctcaagctctgtttgtctgaaaatacctcctttttttaaaaaaaaaatccatattcctgatagttatcttcattaaatacaattttttttttttttgagactgactctatctctattgcccaggctggagtgcagtggcgtgatctcggctcctgcaatctccgcctcctgggttcaagtgattctcatgcctcagcctcccaagtagctgggaccatgggcacacgccaccccacccggctactttttgtatttttagtagagatggggtttcaccatgttgactaggcaggtctcgaactcctgacttaaaatgatccacccgcctcggcctcccaaagtgctgggataacaggcgtgagccactgcgcctggcccaagtataaaatttttgattgaaaggttttggggtcttgtttttattttgtttttgaatactgaaatattactccactttcgtctatctctgttgctgctgagaagtcaatagtaaagatgactgttgctcctttgcaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgcccaacaatgatagactggattaagaaaatgtggcacatatacaccatggaatactatgcagccataaaaaaggatgagttcatgtcctttgtagggacatggatgaaattggaaatcatcattctcagtaaactatcgcaaggacaaaaaaccaaacaccgcatgttctcactcataggtgggaatggaacaatgagaacacatggacataggaaggggaacatcacactctggggactgttgtggggtggggggaggggggagggatagcattaggagatatacctaatgctagatgacgagttagtgggtgcagcacaccagcatggcacatgtatacatatgtaactaacctgcacattgtgcacatgtaccctaaaacttaaagtataataaaaataaaataaaaaaaataaagataatctatctgttttctatcttgtgctgtttctaggatttgatttagactgcttaggattcactggacttcttaaacctgtgatttagagtctttaatcagctgtggaatcttctccgtcattctctcaacaaatagtgcctcttctccattccctctccattctactttcagaactctgttacataaatgttactcttcttcaatctatatttctctgaacaggacttccctagttcccccctctctgccccacatctttttaaaacatccttctgtgcttcattcttattaattccttctgccttactgtctgggtatccatttctcttgccggtctgctgtaaacccatacagttttaaattttgattattgtacttttgacatctagaaatactacttggtcatttttaaggtaacttctcaggtttgtggttccctgtagatatttttcaatgttgttttttatttttctaactgcataaacacaattaagaaaataatctgtctaataattctggaatatgatgttatcgtaggtctgcttctatggtttgctatttcttctggttctcattcaccttgatttctttctttttccaccttgatttcttgtgtgcttaatatgttttttgttttttttttttaccacgtactaaactgaccttaccaatattttctagagataaataaaagcttgagcctagaataaaagtgctttctccagagatgattctcctttgcttttgccaagaaccaagaagcattacttattccacagccaatttcagttgaatatatgacatgggaatacttagtatcacacaagtcatgggtatttgagctgcaaagccaagttgcttctcttgtaatgtggtttcctaataaaggacatatccacatttcagatagaaaggcaggagggtttagactgacaggtcatttggcttataacactgatcacctcaacagcactccagtcattacccctaattctaaatttagcaacactataataaactgtttaactttggatttcctagctgcaaaatggtatcagttcaaacttccgatcaaatgctactgtttaccaaagacctagaatcaatctaaatgcccaccaatggaagactgaataaagaaaacgtggtacatatacaccctggaatactccggagccagaaaaaagaatgagatcatgttctttgcaggaacatggatggagctggaggccattatccttagcaaactaatgcaggaacagaaaaccaagtattgcatgttttcacttataagtgggagttaaatgatgagaacacatgggcagatagaggggaaaaacacacactgtggcttatcagaggatggagggtgggaggagggagaagatcaggaaaataactaatgggtattaggcttaatacttgggtgacaaaataatctgtacaacaaacccccatgacacaagtttacctcataagaaacctagacaggtacccctgaacttacaagttaaattttaaaaagctgttgctgagcacttttctctgtgtagagttccatcacagaggtactttgtggaaaaaaaagtttataaagaattatgcaatctaaaaatgaaaaagatcatgcaagtccattcatccttttggcatggcaccacagagctgtaagactttcaggattcactgagtccaaactcagcattcatcgagtccaaactcttacccatgccagtgtgtgcttacagccactacaccacccatgtgagagagctgggaaacatccttagaaggtgatcctgaacacctgtgtccagatacccctgtcaaaagtgctgcatcacattgagctgaaatccatcagcacagcatatagaagttccagagttaaaccactggagttcaccactcactggctgtgtgaccttaggaaaataactttatctctctgtgtcttactttttctctgctacaaactggaaatattaatagtgcctacctcatagagttattttatgattacgtgagtcagcaaatgaaaggcaattggaaccgtgtctgacacatagcaagaatcatgtttgctattgttattgtcattattattatccatctgaccagcaacccagaagttcttggtctttgaacagccctttaaatattttaccagagctgtcttatctgtccatgcctcttcattcctattctttttacttcttcttcatatgacacggcttagtttgccattgtcatttagaaaactattcttcaaatatgattgcggagaatgtacctctatttctccagacagtgtaactggattactttcttttgttctgtaccgtaggctcacacacggttcctactcaactaaaatctctgagtcagtgtttcccagtatgtccagcagatcaatcgtccagcaaaatgcttcacgagaaggtcaaattaatgaaagaaacagtgcacattatatctgcctcttaaaattcttagagcacgttaacatattaaaagctgagaaggtcatcagtaaagcaacatgttaatcagctctggaatcttcccagattctcagagagagagagagagagagagagagagagagagagagagagagagagagagagagagagagagagagagaacaagcaagagtgacttctgaaggggcgatttaataacagttttcaattatgtgaatggctctcgcataggggcctgtgaccagctgttcgatctctccactgaggacagaacaagaagaaacagacttaagcagcatgaagaatttaggctgtagctcatatggaagaatttcctgatgctgaaagttgttaaagcattagtgtgaattaccaagggaggctgtagaatgttctactctttcaaaaaactatagattcttctatgcttaaaggttgaacattctcaaatttctagcccctaagatgcaagatccatcatgttggctcttttaaaactgctcacctacgccaactgacagactgaagacaaggtacggggattcacgttctcattctgtttcaatctttcatttttatgacaaactactctgtatcctagtggtatattccctctccttttgtctggcaatgaagaaggaaagaattaaaagccaggcaagcttctgtaaagacctaacagaactagaattaaacccagctaaaattacatttcgatcattccagaaaaaaatatatagggatagattggaatagcaggaagttattaaggtcaaaagataagtatgatggcattcactggactgagataatctttgtaagtaccattatttgttgagatacatataagtctcagatataatcccctctcagtatcaagggtgaccttgtcctcatctctaaacaccagtttcaagccatgcaagcaaaatctcttggaaaggtcatttagccctgggttttgttttgtttgttggctttgttttgcttttgctgttgttttggcaataactccattttccccttctatgtcatgcacacacagaaagcaaagctatcacagctccttccattatgatggtcacagtttggaattatgttgggtttctcctctttttctgttggtcctcacctgccagcaactatccataacagaaaagctaggggaaggaatcagttgtcattactattgctctgttacagcacactggagggtggcttcatacaaatatcacctttatacaaatataacaaggtacacagacaaagaattctcaatatctggaatttctagcaaaccgatttacctatcaatataataagtttaaaagggcattacatggcaagtttggaggtaggagagttgctggggttccgaagaacttttggatttctttgatgttgtgctttctataaatccttggacactgaagggccaaccgcctgccaggaggtccacctgaatactcatttttctctcaaggtaataaaatcaattcatggctacagaagaaatgcaattaagtatttctcagcaagccctgcatcccagctaccatgaacacgtacattgtattttttaggagaaggcaattggcatttcaattgtgaggtttgtgaaaaccatgtgaacacttaataaactacaataattagtacagtcatccctcagtatatgctaggggttgcttcctggcccgccgcagccccactcccacggggattttgctgttgagatacagcaaaatccacgcatacgcaagtcccacagtaggcccagctgaacgcatatccgcaggtttcacatctcttgagtactgcattttcgatacgcatttggttgaaaacgatccacttataagtggacccacacagttcaaatctatgtttttcaagggtcaactctatatagagaagtaaacattgggcaagagactgtgcccagtaattctcagataacaagaaaccaccatcctggaaacaatacagaacgatacctccttaatttctttcctaaattgcagattaattaaagacaggaactatacttctggagtctctgttaaaatctgctgaattgaacagtgggtgggaattcaactgcaatatgatcgcaagaaataaaaggaagattataaaatctgtatgaagtcagaattttaaaaagctgcctagtcatcctgaagagcaaaaacatacacttgtaaagattttataaagagcagaagacaaaataagttactttctcaaactgtccaaaatttcctttatcgattacagtaaatgtccttgtgttggtttctatgtgatggtatcacacataaaaggctaacagacttcatctggacttagaaggtatgtacagaatgatctggcttaaaatataggtatacacaaaattcacacttggggcccttgaaaggaactgcacaggcagatagcttttctctaggtcggtggttctcaaccggaaatgatgccgtaccccagaggaaatataacaatgtttggagtgtcgaccaaaaaacatcagagaaaaacatcgccaaatatgttaaatttattttggaattagaaatgaggattacaacccaagatgcatctgaagaggagactgtagagggaaacttttattggtaaaaacagaagtttacataagctgcttggaaacatagttcgtttcagatgctcaacgccagaactggtgtcagtttattagtggggatgccattactgggcagatgttcttttgagagcatattacgtgcactgctgcagtcctaacagaggaatttcttgtggggcgattttagaaagtccttgagacagtctttatctcaggcatgtaaccatgaaccctcctcctttcatgctgccctggctctagttagtttgggactgacaaaaagtgatttcatcctggtatcttttacgggagacatttttggttgtcacaactgggcgggggggggggggggggggggagggggagggcggggagggggtgctactagcatttagtagatagaggccaggattctgcaaaacatccagcagcacacagggcagcttcccacaacaaagaactagaatgattcgggccaaagcatcagtagcaccaaggttgagaaaccctgccccaatgttaacatcttacataaccatatggttcacttgtcaaaactaagaaatccacattgattcatcactattcactaaacaacagacttccctgagagtcctgcaagggcatttaataagccggcaactatcctctacaacacagaaactgggaggctaccataggcctattcaactgccgaaatgccacactcgttcataaactgagggtagagagagcaaaagggaaattaaaagccccaaactagaagtcacaaggaaacacgctaaaattgtagactcagatttgaaatcaagttgcttctcaaactgacaactctatgcagtgtattccaggataaacagttgcagaaatttatttatttaatcatggcagataattatcccaagcaaggtaaagcaggtctgctagtacaatgtgtatgtgtgtgtgtgtgtgtgtgtgttttgattttacttagtacaggtcataaccatttagagaaaaaataagaactaaatatgcaaatattaaatacatacatatccataaatagaattcctaaacatttttattgacagaaaaaggtaaatttatggaaaacattgtgggcaaaccacagatttttaaaaagggtaatctctcctttgtggctgatatggtttggctgtgtccccacccaaatctcatcttgaattataactcccacaattcccacatgtcgtgggaggagcctggtgggaggtgattgacttatgggggttggtctttcctgcgccgttctcgtgatagtgaatgagtctcacactatctgatggttttaaaaacgggagtttctctgcacaagctctttttttgcctgctgccatccaggtaagttgtgacttgctcctccttgccttctgccatgattgtgaggcctccccagccacgtggaactgttaagtccaatgaccctctctcttttgtaaattgccccatctcaggtatgtctttatcagcagcgtgaaaacggactaatacagtggccattttcatttgctattttcattagtaacatgttcccttcataaatccaaaaaatcatttcaatgtcattgccattgttaataggtattggcattaatagctgacaactcaacttttctagccctcgttataaaaagccttagcatttggaaagatttgctgaatttaaatttataaaaactgttttttgaattacagtctgtacacaaagatttaaaactacaaggagaacggttagtcagggtcagacagtataggacaggcagtccctgactgttccctgatctgttattacaatttctttaacaacctctaaatctaccaagggcatcagtggaatattttacataagagagaagtctgcaccagcagagaacataaaaggaggaacaagaacaagctgtaaagaatattaatgactcttcttccaaacaatcccaatttttatgaaaatcaaatgagtgataaaaagactctataaaactatacaaaacctgcatgtaacaaataaaacagaaggaaggtgacattttgatcctcttagacacaagatacttgggttttacctttgagttactgaggaaactatagtgtacggacgcaagggatcatttacatgaggttgtacacaatggtttttcacatcttgctcttagtgtgtgtttccattcagagaacacttggtctcatgtgaaatgccacactctatgtacaagactgttttctatatcttatagctctgatacaagagttgttacccggaagatcaggtaagactttgctgatcatggccaagctttgaaataagtacaataatccatttccctttcggcctttataacatttagcatagaatcaaagacacttagggataagtaacttttgagataacctgttttaactttatgttacagataagaaaaggcccaaagaggttaaggaaacagcttaagattatctacgattttaatactgaaatatatgcttaaaatagtcttaaaaagacaggacaaaagtgatttcctatgggaaaaagcaaggcgatccccaaaatcttttgaatctttaatttgtttgaaagtactagagtctgatagctaagtaagcaaggcccacttaggacaatttccaggtgaatataaatcttcaactgaattatatgccgataacatggctgcgagagccaatggaaggtgcaagtgaataccccacaacactgataaatgcatacttatatctcatctgatcaactcctttcccccttcttttcagcattacatgtccctcgtaccattagatgctacggcatgtatgagctacctggactgacaggtgcgggtccatatatattgaagtggcaaaaaggaaaaaaaagaaacaaaactctatgagcttctcaattcagcacagttttcatgttacgtgttttaattatgtcaatgtgttgttcccataaaaggattggttaatatggaaatgtatttattagacatctgtttatgtggctctctggagaaaggactttcaattccatacactgccattttaaacaattccaagacaaaaatagtatccaatggcagttcagtaaagagagatatcattctttgtacactcagaaccaccttggatgtccacagtgatattcatgaatagacgggggagaggtagaagctcttctttacataagaaaatggtctaatacatgcagaaagtatggtagaattagaaagccaccattatgcaaccaccaatattataactgaattagacaaggatcatccataaatgctaaaaccatagggtaaaaggttaaggaatggatattataatatgtcaaaatatcaaaaaattactttctcattacaaagggaaaaggatattttacaaggaaagtatcttgtagacaccaccttaacattcttagtgataccaataggaacaaaatgttattttgttcctccagattgtgatacagtggtaggtacagagcatcatcttatcgtcttttggccaaaaaatgttaacattaatctaatcacaaggaaaccatcagaaaagcccagagtatgggacattcttcaagagaactggtctgaactcttcaaaaatgtcaacgtcagcccggcgtggtggctgatacctgtaattccagtactttgggaggccgaggcaggtggatcacctgaggtcaggagttcaagaccagcctggccaacgtggtgaaaccctgtctctactaaaaatacaaaaatcagccgggtgtggtggtgcatgcctgtaatcccagctactcctgaggctgaggtggagagtcacatgaactcgggaagcagaggttgcagtgagccgagattgcgccactgcactccagcctgggtgacagagcgagactctgtccccctaccaaaaaagtcaatgtcatgaaaggaaaacaaaatgctgggagactgttcaaaactaaatgaaggtacagagacatgacagacaaaaaccttgactagatgctggaagaaaacagtggctataaggaacaattctggggcactggggaaagttcagtgtggactgcatatcagagggtattgctggattgctgttaaatttgtgtgtaacgatagcattgcagttatgttagagaatgtcatcctttaagaaaatggtgtatggtgaagtgtttaggggtttatgttgtgatgctcctttacttttaaatggcataggggaaaatgtgtttgtgtgtgtatgtacacagacagacacatacataaacagagctgagagggtggaggaggtaagtagagcgaaaagcaaccatggattgaacagatgtatgacacagatgagtgttctttagactatcctttcaactactctttgtgcttgaaatgtttccaaaataaaacgttggttggaaaccgttatttctcccaagtcaccccttcatgggaataggttgtgggcaaggcaggagggtgggcaagagtgattttagtaactgtgaaagggacaggacaatggtattaatgtcaatagtaatgagtgtgaaaagttccccaggattcgttttctctaaaaatacaaacctaacgcaaaattgatttccttcctgtccttgtcacggttcttaaagcatctcctcatcgactctgcctagatgtgcttttcctagatccctaaatgtgaatctccaggcatgaaaatgagtttaagagtccccacatgcgcagaagcagaactttttgtttaaggattgagaggtcaagagttgtctttgtgagacaagaagaagtaaaaggcttcccataactaccatcttgggtagaaatcaagtattttatttaaagttctgaagataatgagcaggtaggaggccagcagtcactgctctaaatattaatcaggactctgaatcacccattaaagataaaatcagcccaaacaataacacatggtgattatccactcttcatttccatgttcaaggacaactgtcctgacctcaggctctgcactccacctgactaataaaccaattaacgccatggccctagggaacatatgcacaattttaaatctatgcaaatccctaagtatactcaacagtattaatttatgctaccgagttctaatttaacaggaaagttaaattagaaaagtttcacatatacatggtaaagcacatatatctgtctataggtaccatggaatatactttcccaagtgtggatcagggcgcattatgtaaaagaacaagatataaagttagctcttccactactgcctcctacaatcctttaaaatccagttcaggaaaaggcaaaattacaggaacagaaaacagagctgtggtttccagagattgggacttagtgagatgatacagcatgatggaattttaggggtgatagaaatggaaggaagaaaggaaggaaggagggaaggagaaggggacagagagagggagggagggagagagagagaacgaaagaaaagagaaaagaaagaaagaaaggaaaggagaggagaggaaaggaagagaggcgggagggagggcaggaaggaaggaaggaaaagacagggtgagaggaaggaaggaagaaagaaagatttggtcataacaatgaagtgctactttagaaggatgaagatggaaaacaaaatgacatgtgcttttccttagcagtaagtgtataaacaaaacaggtttcaactacaacacaaacctatcttcaaaattctggtgaagaaaacatccattactccaatagagaagttaatcaaacaaaccacttaaacagatcatcataaagcttaacccacggtagcttaaaatttttaaaaataacaactggaaaccaatattaaacttaagacaatactgataatactctgataagggtcttttctgaaaattgcaggaattttaactaactgttcatgagcaggcccagtaagaggtcggtgatatctctcagcttttcatggcagccagctatctctatggaaggctgattggactattagggtctaccttcaattctgggaaaggccacctctttataaataccaaattgtagtaactcttactaattacttagttactagtgagtattcatccgtccaaaaggggtgtaaaaggaatgtctatggaaccaaagggcccacagtctgattaatacacaaaaagccaaaggaaacctaagtgaaggagggtttttaggagttactttcaggatggaaaatctattaataaaatggaatcggccaggtgtgatggctcatgcctgtaatcccagcactttgggaggctgaggtgggcggatcacaaggtcaagagattgagaccatcctggccaacatggtgaaaccttctctattaaaaatacaaaaattagctgggcgtggtggcacgtgcctgtagtcccagctacttgggaggctgaggcaggagaatcacttgaacctgggaggtggaggttgcagtgtgccgagatggcaccactggactccagcctggcaacagagcgagactctgtctcaaaaaaaaaaaaaaaaaaaaaaaaaaaaaaaaaaaaaaaaaaaaaaaagtaatcagttgacccggggaatgctgtctaaccagccaaaagtctcctgatatggcattttaacatttgcagagaaacagaatctccagaatctctaaaatgcaatccacagatgatgttttgttatagataaaagcaactgttaacattggcaggatattttcatgccacaacacactttagataatcatagctaacattcactgggcaccttctatgtatccactacagctcttaagtgctttgcttctattggttcatttaatcctcacaatcacctccaggagttcaggggccaggaaggttaagaaatgtgtccacagtcacacagccagcaaatagcagagctcagatttggactcaggcacagttcggtttcaaagcctatgcacttaaccactctgccagtcacttctccagatattctggaatgctttctcatttatgtgttactgatcctcccacctcagtctcctgagtagctgggactacaggggcatgccaccatgcatggcaacaataatacattgtatatttcaaaataactaaaagagtagaattgggaatgtttctaacacagagaaatacttgttctcaacagttgagactgtaatttattctcattttcatatcattctacattattacaacaactgtgcatagatggtattcatttttgtcatacaaatagagaaattcagaagatagatggaaaagcaacttactcatttggaatactaagtacaacaggaggcagaaaacagatgtaaaataaacagattttgacactccagctctcataggtgaagcatattgaatataaagttggtatacttgacgttatctaaacaataaagtccttaaaatgtttactgaagaagatactacaaaatcgaaaccacaaaaagatatctgcactcccatgttgactgcagcattgttcacaatagccaagatatagaatcaacctaagcgcccatcagtggatgaatgcataaagaaaatgtactataaacacataatggaatattattcagccataaaaaatgaaatcccattatttgcagcaacatgtacggaaccggaagacgttatgttgagatcagccacacacagaaagacaagtatcccatgttctcactcatgtgtgggagctaaaaaaaaaaaaaaaaaaaaaaattgaactcatggagatagagtaaaatcatgactaccagagtctgggaaatgtagtgaagatcgggggataaaaaagggatggttaatgggtacaaaaatacagtaagaagaaatatgatctagtgtttggtagcacaataaggccactatagtaatcaatatatttttaaatctttttacagatagggtctcactatgctgtccatgttggagtgtagtgactattcacaggtgcaattgttgtgcattacagccttgaattcctgggcgcaagtgatcctcccacctcagcctcctgaaacgctggtcctacaggtgcgtgctaccatgcatggcaacaataatttattgtatatttcaaaataactaaaagagtgaaatgggaatgttcctaccagagaaatgatgaatgtttgagatgatggacaccccaattactctgattgtgttaccctacacattgtatgcttgtatcaaaatatcacatgtaacccataaatgagtactattatgtgtccataataattaaaaatattttaaaacatacttttttacctgttaaatgactggcagtgcaggtttgtgaaataattcttcgtgctatgatgttacaatggctacagtgtcacaaagtaatgcgaatttttcagttccattataatctcttcttacgttgatcttatgggaccaccatagtatatatggcctgtcattgaccaaaacgtcattcttcagcacatgactgtatagttttcccacctaaaagtgatacttggttttatctgaagatagactaaacagctatgttgggattagagtattttcaataaagatgggtgtgtgtgcatgtatgtgttttgggggaggggtgtttatttatctatctcattctattacaatctaaaattcatataggggatcacattgacacattaacactctgtcatttcaatctagtctccgaactggttgaagccataacatgatgtaaattgcacgatgtagactagattcattgtgccactgtgggcctgttttctcatctgaaaaaggagaggtgcagaaaatcctcaaggttccttcaggcagtctatgtgactcactgccagggcaggcttggccttactaaggtcgtaaaaatcaatctaatctctcaacagggctgtttccatggaatatgagaaaggaacaagctggcaatatattaattacagctgtatctcttaaactcgttgcaaaactttacttctatcactaccaaaatgagtcaatttcccagtaaatgtgttgactgcaatatgctattaatgtggaaacatatcctgttgcctcatttagtatctacgaagataccactgtcaaagccataaatttacagtgactattcctttttcatatccatggatgtgacttcatttcctggcttaatggataattccttggaagacctatagtgatttttaaataagcaaaattttacatttagacctgataggtgatttccttttctaagtggttagtggggagggatatgagaaaacctttaatagataatccagagagtgtggcacacaaacacgtacctctcttcttgccactactgggcccttgtctgaatcagaagattcagtacctttctaactgtaccaacctgaaacaaagtaaggtttccaggtggtgacaagaaatcaaaggaaatcaaatctgcaatgcaaggaatgcacttgtaggataaacaagtactttattaccgtttacctcaggctggtagaaatagcagcctttgagcacaagcttgctgaaggaaccagcccagcctcattctgaaggtcctatacttcaaacaaagggcagaggacattttcactcctgttatctttccctacagcaaacattgtatttttatgcacgtggcacaatgaaaggcaaggtgaccgccagtgcacctggccgaggaaaagcatgccagggccaggacgtggattcctaagtattcctaagtatttacaatggatccattcaacctgattgcaaattgctaaaacgctgagaggctccccaaatctaagtaatgaaagcctcgccatacatatggaatttactagcatctgattagaaatactacatttgccagcacttcaaactaattcctcttccccctcaagggtcccctgtcttgttataccttttcttattctatccaggactcaggaaaagtagctgttgtttggccttgggaagctggagagcagaagtatcagaaactacatatttgggaatgaggtagtaaatgtggcggtgggcatactggactaggaatcaaacccttccaccagctgagggactttaagggcgcaaataaattattcatccacttaaacaataataaaagcaaaatctccaaagcctgactattctgttcccctcaaagacttggtgaggattaaatgagagaattcatgtgaacaaagttttgttagtagcaatggtaacaatattatttataagcataataggtacaaatggtaaggagaagctgtttcatgatagtgaaagcaaactatgggtggttatgaaaccagagtaggaaaggtctgagagttaaatagaggaattaggatttgttcactagacaacagaaagatactgacattttcaaggacggcatcatatgggaaatgcttttctctaaaactagtatgagggcaataagaccaatgaaaaggactggagtgtgaagtggaggcttgctaggaagccagtgcaatgatgagaaggcctggaaacaatgtaagaatggcaatggaaagcaatcaaacaaaacatgtttctttccctaaaaaaagaggcagcactttactaattttttttctaattataaatgttcaaagaagaaaactcagaaaataaaaatagtacagagaaaatcaaaagccacctgttaccaccattcatatcttgactgatttccccccagtctcatagaaaacatttcaaggctggatgccgtggctcacgcctgtactcccaacattttgggaggctgaggtgggtggacagcttgagcccaagagctcgagaccagcctaggcaacatggcgagagaccctgtacacacacacacacacacacacacacacacacacacacacgcacacacacacacatacaccaaaaaaatgccaggcgtggcggtccatgcctgtagtcccagctactcaggaggctgaggtgggaggatcacttgagcccagaggtcgaggctgcaatgagctgtgatcgtgccactgcactccagcctgggtgacgaagttagaccccttctgaaaacaaaacaaaacacatttcacatttcaaagagcttggagactggctggccaaccaggaggcattcaacaaatatgcaaggatggactgaattcaaagctttgagactgagaatacagagttgttattacagagacagaaatgtaaccaaaccagagacatgggcttaggggagtaggaggttatccagcaaaaggatgtagcaggcagaaatggaataggttggtctcctgataaggggggcagcccagggaaagcagagcttctgtatggccaccgcttatcctgacaaccaaatccaagagggccagaggctgcagtgaggatggtggtggcttcctgatgagtcagtactcgggcgagaaaacaaagaatccagctggccctgaatacagcctagtttactttgcagcagggaccatcactgagccttacctttaacccaagtcacaatgcacacacatatgtttatatatccctatatatgaacacgtgtgtgtgtttcactagaactcaaagagtaactgagacttgactaaaggggaaaaatgattaggacctgtaatcccagcactttgggaggccgaggcaggtggattgcttgagatcaggagtttgagctcagcctggccaacatggtgaaaccctgtctccacaaaaaattagccaggcatggtggcaggcaccctgtaatcccagctactcgggaggctgaggcatgacaattgcttgaaccagggaggcggaggttgcagtgagccgagatcgcgccattgcactccagcctgggcgacagagggagactccatctcaaaacaaaacaaaacaaaaaaaacacacaaccaaaagattaggaaataactcgcgtttatggcaagttgttttataattggattttaaaaaatcaaaatgaacctagattgcctgtggccattaatattcattgtatggaagttacttgtgtctacattttgatgattgattggattgatcatctatctgcattttggaaggtttgggtatgaggaggaaaagatatttatttctccacatgcattttacatttacaactaatttgccataattttggcaaaataattcaaacagtatatcccactttacataaatgaacttattatgtgtgcatccggtaaatctatccaactaactattaaataaatactcaaactgctttaaacacctaaatattcacagtgatctgcccaggaaaccttctatagtttcatcctagtctgtggtcaaagacttcagatataacccagttagttctacagctagttccattttgtaaatctcagccattgttaatagaattagaatggattgagaaaccctacataagaaaaacagctcttagcacttgaaaaaaccaaaaacaaaaacataagaacactgtgaataatgtgataccgaaagcatcttactccttcaatactgatagcgttacaattagaacaacttttgaagaaaggccacaaaaaatgtttatattattttgtctggcaatcacacgcctgagaattgatcctataaagaaagcttcaaagacaaaagctaaacgataaggatgttcattgtagcactatctacctaataaaaattagaggccaggcacggtggcttacgcctgtaatccgagcactttgggagttcgaggcaggtggatcacctgaggtcaggagtttgagaccagcctggccaacctggtgaaaccctgtctctactaaaaatacaaaaattagcttggggtggcggtgggcgcctgtaatcccagctactcgggaggctgaggtagcagaatcacttgaacccgggaggtggaggttgcagtgagcagagatctcaccactgcactccagcctgggtgacagagcgagactgcaactcaaaaaagaaaaaaaaaaaaaaaaggaaagagaaaaaaaaattagaacaagatgaatgtctaccagtggagtgctcaggcatttgggaagaagagggtgtttctggggcactgactacgacagagaaaaagcaatgggacaggataggaaagagaacggacaagagtgtgttcagtcagtgatggacattagcagagagtatacacctctagactttggaataataggggaatgtcaaagctacaaaggacagttttaaaaaaaaggacagctgtgctaacaatttaccaacagccattgaaaggaggctataatgatagaattagagaaaggactcagagactaagagactcgcctacaaaggccattttcttatatacataggatttctgtggctagagacttatttcctcccttgctgaacttcttcccctctagcacctcaataactgtggggtccctgctgcagatggagatttcttttccttcctcagcactgtcttctttcccaaaacctagagttccagaagctgcttacttacagaggttccaaatatcccaaatcccatacctactgcctactgaagagctaatatgagaaaacgaagctctgtgggttttttaattaatttctaaaatatgaaagaataaatatgttacctagaaggtgaataacttacaaattggaagcagctccggacacttggctcaatgttactgcccccaaaggatgcaacttcacccaactgtcttggaatttggatagaatcatgcagaaggaggcccagcctgcgctggtcacaaaatcctgttgaacttgccacttgcttgaaaaggtctacaaaggaagaagaaaattgcaacagtcaaaacacagcacccatggatgccagcagaacctgacatccaactcaattccagtagcaattctcaagagtagccagtatttccacagagtggggttacttctaatttgtgctaatctggatatttattatttttatgaatcaagttaatgatcactgtatatatatgaagtgtgataacttttacataaactgtgtcactgcaagaagcgcaagcttacacgtaccctcgacacttaaatttcttctaagccagaacataatccttgggaattattgtatataggatgtaactacatcaaaaaataagtgttttagcattaagagacatataactggcccaaagcaccaccctccttggacaccagagattcaaaaatgtaccacagttgggacttctttatggagtcataagatcactgagcttctagtccatcatgtatgtgttcccacaggatactgtgcatagtttgttgttgttgttgttgttttttgagacggagtcttgctctgtcgcccaggctgcagtgcagtggtgcgatctctgctcaccgcaacctctgcctcccgggttcaagccattctcctgcctcagccgcctgagtagctgcgattacaggcacatgccatcacacccagctaatttttgtatttttactggagacgtgtttcaccatgatggccaggctggtcttgaactcctgacctcaagtgatcctcctacctcggcctccctaagtgctgggattacaggtgtgagctactgcgcctggctgcgtatttctaattaatagctcacatcatgttatgctggcattgattcaatatgtgtctatcgtttttggcaggagacttatatccccttgagggaaggaaccatatcttggtcagttgtgtgccagaagtatctacagtagaatggcagtacccggtggatagtaggtgcccaatatatgtaacagaatgaatgaacatactgaatgcttgcaatgttatgttttgttctcagatataaaattttaatcataccttatattcacctagaagttgcccctcaaaaaaagtaaatccaagaaagctttctgtacccataagcacactttaaactctaggaaattaaatgttttaacaggatacctaagatggcactaaaaattgagattgtacgcacagctttttatctgctctccgatatacatacctaggtgtttattttcaaagttatgagttactttcaaacatctcattttgcatttaatatttttgtttcaccaacctaaaaacatgttccctcttagtagttattcgaaacaccaactcaaagcttcctcaattattcaatttaatattatatttacaatgtgctgtcactataccatatatacggtagattagaacctaacctatactaagtaactacaatatttaaaggagaaaagcacacaggtatcccatctcatccgaaatacattttaaaatggttaacaaaagctgttcagttatttttctctcgttctgaggatgagaaaactcaagtggaaactacataaaagtgagggccaaaatggtttgtgtattttgtggcttactcctgaaggagaaatgatcagtaggagacagagtggcttttatctcctgcctgtcctgaagcttagcacatctcctcacatgtgtggctaggcctcaggggaagagagaaaagacaagctaggctgaatttgtttaatattcctactgaaaagattgcttataagcatttcaaggggaaaaccaactgcagcctttcacaatatgaatggatggtcacttggtcatctgaaccatcactcctctagcattggcttttaatttggttttacagtttttaagcagaagaacccaatgcgtaatcaaaaggaaattctgtagggtggtacgtatctatcctttaagaaacagcaagctatctgtctctcaaataataaaatgttagtcacgtcacggaattggatgtgtcagtacaacttgcagtaagatgattataaaataaacaatgtttcttgaacatgaatgtcacatggtattctttaaataagaacccaaagactagacaagtgcagagattaaatcttcacacttatttttccgacttacagaaagaggttagaaaatcagactttatcccctaggaacatgtgttttattcagacacagtcaatgtaatgtaaaataatacctggactggaaaagctaatcctcattctctacttaaatgcctgcaatttaatgtttgacaaggaatggcacaaaccaaattttatgacactctaaaagcagttctacatcttacatgaggaatctgctgtcaaataagaacagtctgtcatttcccatctagaactagggtaattagccaacattaataaaagaatacagcattaatatacacgacttacatctgtacttgtcttccaaatgtgctttacacagggaaatgatgccagttttaaaagacaggacacggatcctccctgttcgtcccctattatgaagaatcaaagcagaaaacaattactgaccctttcctagagggtaaacacttctagttaagaataaagccttgaaaaggaaaaataaaggagtaaagtgctcaatgatgtgtgaactctattgaccactgttttattaagattgttttgaacttttccaaattcattatctctttgactgatgacctacaatgcaatggaaattcaaccaacttgaccactgaatgtttaccaagtttcaattcctaaaaacccttatttgaactgcaaaagttctacataaattaagaaaaaaaaattctattcacctatggaaagccaccttggtttaagttggtaagcagaagaattactaatcttcaccaatctactttggttactaaagcaaattacctactttggtcatggaagccaaaaaaattaccagcaactaactgctcagccctcttaaatgctcagatcttcatcagattgccccttattgaaagaaaattaattacttcaggccacataacacataatatagaatataaatgtttatctccgtaagaaaaatatcatactctattaaacaacattcaaatatatgatctaaaaaataaatttataaataacctgttgctatatcagtgttttaatatagattgcttttatttgcatagcattttctatatttgcatatagaaaactgaaataaagcatttcacataacaaatttattaataagctaattttatccatgggggaaaaaaaggaaaaataagaatgaaaagttttccattttgtagaaaatgtctttcaagacatggaatcaatatgaatgcccatcaatgagaaatatggtacatatacactatggaataccatgcagctataaaaaagaatgagatcatgtcttttgaacacggattagctggagactattatccttagcaaactaatgcagaaacagaaaagtaaatactgcatgttctcacttctaagtggaagctaaatgatgagagctcacgaacacaagggaacaacagatactggggtcttgagggtggagggtggaaggagggagaggagcagaaaagacaactgttgggtactgcgcttaacccatttatgctggaggctgcatattactttttgtgaaaatcagaccttggcgatgaccttgagcagtaggataggaataattcccacaagcttagtgttccaataatggaacactaggcataaatgggttaatacctgagtgatgaaataatctgtacaacaaacccccgtgacgtgagtttacctatgtaacagaccttcacataataccccgaaacctaaaattaaagttaaaaagtgtctttcaatagttttttggcttcttattttattacggaaagctactggcccttagatattggtaaaaagaaaaaggagaaaatatttcagaataattcgcctattagcacttcaaaatcacaaaggataggtcccaatggcggttattttcggtgaacaatatgctcaacttccagctactaaaatttattaaatccctcagtcaaaaagaaatcctgggcactaatggactaaacaaattcctatcactggaaaattttcttatctttctccctcttaagaaaaggtagatcaaaatttaacaaatccactttatacagcaactcaggtcttcaaggagttaaaattgtcaccaaatacttttcagtcaggtagaaggaagttatacattcagaatgcattcacatgtcatctgcaaagaaaacagtgccaaaatatatttgaggggaaacctgaatacaaactcttatcaaaactaatgtgaacgtagttcacaattgaaatccgacatgttcaaggacttggtagatgactatgatgaatgtaatagtcaggtggtcctgaaattttaaaaagcaataccttatcaaaataagaaagaaaaaaaggtataaattttagttcaaaaggtagtagaagtctacaacaaaggtaaaaggcaaaacagttgttttgcaactcttttcagaaaaccttcccagatttccaaatgggagtatgttcttgattggtgaaatgaggcatgtaataattttgagatctaagaagaatttaggcaaaattaagaccaattccttctgctcccttcttcaattgtcttcattaagctcaagaaaaaaaaaaatcagaactggggatatctcccttgtgtgcaatccaaaacaaacaattgttctctaagagagagtgatgaatggaggcgccaaactgaaacttcataaaatcttattaaaaaacaaaagaaaacgaaaaatgttctcagtttgagaagctaagtttgctgtattaagggcttgttttcattttgtttggcctatcaattcataatcttctgcaaaagtgtcctaagtatcagctaagaccattctgatctggagacaggtgtgccagtatctccaggagcacagccatggccgccagtgagaggaagccacccctgaagtgcatggaagaattccaaaatccatgggcgagaaagggaaagaaccaaaggctatatgtcgactcattccactatttgcaaaatgagtgtctcagggttttgtttgttttctaatctgagagcaatctacattctggctcttaactcctagcttatcaaaatatttttcaagtcataaatgcaaaaatgatttatcacaggaagagcattaggtccacagcttccagggccctgttgtaatgctaattacacttcaccattctgtacgctaagcctcctgtgacagagcccgggaaataaaaacatgccatacgtacgtatcataaacattcagcagccagttcagacacatatccacgcagagagggacgttgaccaaattgttgtgctcttgctccaggcggtcataaatagtggtcaaacaattaataatctgcaggatatccatgggctggtcattttgcttgaggttgtgctggtccaaggcatcacatgcagctgacaggctcaagagatccactgcaaaaaacaaataaaatcacaaatgactcaaagagtaaaaccttcctttcagtgtcctttttcctctgagaatcctagctaggactctctcataccctttaataaacaccaaacgtgaaccacactctctttgaaaggtgttttatttttatgcctcgactctaagttgatgagtttgatcagtattcaggatctgaagttgttcttaaatctcactggcattgggtgaagatatgggcaaagatataattcccatccttggattactggggaatatctgagagttaaggggacctagcctgttctacataaacagagtcaattgtcacctgaataagaaaaaaaaaatgttttagcagaaatttttaaagagatccgatgatactttcttgtattagcattagagaagatctgttagattaatctgtatggctaaggttgtgtaaactctatttctagctatgcatttataatcattaagcgcttttctccttgaaatatcagtcacctcagcatctctctgctaccctaatattaggtgaaaaaaatactctccactaaaattttctataggcaaactaaagtaattgcataatctatccagttttcagacctgaggctcgcttatttctcctttcaccttcaaattgtatttcataatattctttctaagtcctctaacaactttataaggctgagggaggaaaattcccttgatctgaggaggtgtttaatcttatgctggggacaaaaatttaacaaaagtgaaacttcaaccttgtccaacatcagcaaatcacaagctttattcccaagtgtcatgaaaagatgcatttctctaaagccaatttattagccaaactagaaacacaacaacattgcttttatactaccttatacacctaagctctggttggaattctcagtcctttgaggcaaggaatcaatgctaattaagtaaatctctcatgcatctagggggaaggggcaattcaattataaatgtagttcacataaatagaggtaaatcccgctcagtaaacacctttcccagtaataaagaaatgcaaacttaaggctttagtatattttacaagttattcatggccagttctaattaaatattaagaaaaaaacaaaaatagtggttaatacctatgtaggtttgtgcaaaaatacttttccacctatattgcgcacacatttttctcttttaaaaaaaggaaaacagaaaatcctggagtttccccagaagcatgaaacagacatggtggtggaagcaggagtctgcactcctcccttggaagggaaggcccctctgtttttgctctgaaatactctaaagatagagaaatgacccttttcatggaagctgagactttctttaaagtgggaggaaggaagataacttgggagacttatctgaagaatcaagtgagaaaaataataaagaattttaaaaagcaatgcaaggaggcaggaggacgggaggacgtgaggagggaatggctgaaagaagactgcgtgggaggctggagcgaggtccagagacaaaagactcaaacttttcttctctctctcttctgtgtgcttgttttcctcagagggcacatactcaagtgcacgtagtaggaacacttagaaacacggtatgccagctccattactggaagagaggaatggatttcttccaaacaccaatattcccaacatgtttccttatatactgaaggaagctatgggtggtttgaagtttttcaattattttcttttttgttactctgctttagtcatcataaatattttgcctctgatccaggcatttaagaagtaactagtgaaaatttttcgaatcacttttgtattaagagtcttatttagccgtgtgatggaaatgaacagagaaaaactgcatgcatttcattttatggggcctgctcttatctctgtacaggtgaatgggtaacacatagaacagcaaatgttgagtagaaatagctccagaggggagcaaagcaattgctctgaaattacaggagcagaagatgacacagttaggagagaaatactgtgcagtgtgctctgctaaaactggatgtggttaaacacaagaacaatccatcacagaagactgaagagcacatttccctaaacaaacatgtcaaacagaattcaactttcatggagctattttgaaaaaatttccatttaggtatacacaatccatgctatggacccgaaaaggaggtgagaatatcaatagggacaatttaattgccatgcatatgcttttcaaaatgagcatcttagagaacacacctagactttttgatgaaacattaaatgtaatgattagctctttctaggaccctcaataagcaaccagcagatacagttgtgtgaaaccattgtttccttaagctaggaatttccattaaatatattatatatatatatatatatatgtgtgtgtgtatgtgtgtgtgtgtgtgtgtgtgtttgtgtgtattcactagtagatatatctttaaagctacataaaaacccaagtattctaatacatcttcactttctaaattatgtttacagtagaggatgctataggctttgaagccattgaagaacagggaccatgtggtggtaccctatgcatgagggctgtgggggtgagagagggtggggacaggataaaagaaatggctgactctccaggatcctctttgctgtgcaggaaaagcagacagtggcggttggggggcggcgagcaggcaggacttcaacacagggatcccactaatggttcctgaggctctggttgtgcctaatcatcttctcaaccttctagcttcaaaagctcattcttttcctttctatgtatgccacagtagctaactcttgctattccttcctatgtaagacagattttttttgtcttttacagagtgatagactcttagagccagaaggttgctttaaaatcattttgcagttgagacaactgagaccagagatatggagactcactctgggtgttatggcaggatatctaggttttctgatttctcatggaggtacatattgtaagggggaaaagtgggtggcagaaggtgtccttactgactttacagaacaggaaaaccattctgcattccatgctaatgacaacagtaggataaaacagaagcaccaaaaagttggttagtggagaaaaaaaaagtctcatggtgcccatataaccccaagttcatcctataggtcaatctgtatattctatgttgatgtataaataattctgtgatctaattagcacagaaacagaaagaggtgagtaatggtggaagaactgctgtatgtttgctgatttttcttgcccaggcatgccactctacaggcaacttacacttatggctgagggacctcccaagcaaatctttgcacttcaagaaagtcaatgcactttgatgtagttgtctgtgcagtaagggttaattccagagaggctggagttggcacgagatgacttgctaaaatatctacacagtgcagagccctggtcaaagcacttgcttttcaaagtgacttactgtgttgaagtgtagccatgggttgcaggttatcaccattgtttattgctaacagtaacattgaccatttttacccgggcacagtcagaccaacggaagccactgagtttgaggctggttacataggaacagtatgcctaggttacccacgggatataagaaaccctggctgaaactccaatttgtgctccctggtttccaaggtgttctgtgctcacatcagtagctcttgttccaagagagaaaatgcatcgtggtgtggctcttgcagacagagggcaattatagcttgcacctgtcctctctggaccctatgctgtgaggcaggctgtggctgtgacacttattcttgttttaatgttgtgggtatattgcatcctttttctgcaaggaactctagattcgtaagcactgtcatttggttcctgtgagtcctctttagcaattgaaccctgtttaacttccactgtcagggcagtgagtgtcagaagcaagattgtttagaacacctccaactcattcttagctaaaagtatgactgaggcattatttagaaagaaaaaaagaagattctgataaaagggatgaaaaagaacctttgaagttgctcaacaagctacgcttggttgaaaagtaacacaggctttgaaattggttactgatggtgtaactttctagtggaatctggaagtgagagaacttgaacctaaggagctaacaaaatggattaggaggcaattgcaaactgatggcaaggctgctaaaaaaaaatccaaaagctaatgttaagttcagaatttctttccactgggcttcaccctctctggcctgcaggtggagtcccaaccaaaaagctgaagcaactatcatttttgagaaatgggctacacctgtgagaccagttacaattaaaaagataattcaagtggggcacttacaggtattccctatgtcactacaggtttcttttttgatgccagacctagtagtccctgaactggggctacaattaagagtttcaaaggctggtaatattccaaaataagatactatggctattagttggtacttaagcacaagcattccacaaggatcaatggaatggattactccttccttgtgccttgcctaattgaagctatcacacaaccccatcataggttgaaaatatcttaagtcacaaatgcatttaatacacctaactaactgaaactcacagcttagcctagcctaccttcaatgtgctcccaacacttacatcggcctacagttgggcaaaactgtctagcaacaccttacacagtaaagtgtcagttgtttagcctcatgatcttgtggctgactgggagctgaggttcagtgctgctgcccagcaaggggagagagtatcataccgcatattactagccttggaaaagatcaaaattcaaatctagaagtagagtttctattgaatgcatatcactttgcatcactgtgaaatcaaaaaattgttaagttgaaacttcacaagttggggactgtctgcattgtgtggtgtgtgtgtgtagctggggaagaggtttggcttaaaattaatgataaaaggaaaaaggtgagattgttgcaaggggaaggaaaccaccaaagatacttttttatttcttttttcttttttttttttttttttttttgagaccgagtcttgctctgtcacccaggctggaggacagtggcgcgatctcggctcgctgcaagctccgcctcccaggttcacgccattctcctgcctcagactcccgagtagctgggactacagtcgctcgccatcacgcctggctaattttttgtatttttagtagagatggggtttcaccgtgttagccaggatggcctcgaactcctgacctcgtgatctgcctgcctcggcctcccgaagtgctgggattacaggcgtgagccaccgagcccagccgatacttttttttttttttaaagggaaaacctaatataatgttgctgcctacggagaggtttaaaataagagaataatatgctcccttggcttagactcagatgcctcttggggtgggggactctgctaaaacctcctcctccttgaaagagccaagatgtgagtgggagagtcagccaacctatccaacacactggatgacgagatgggcgttctaactgcgactacaacaccatggagcaatattaatgtggcttttggttagtattcgttaatgtcttttggttcttctttcacaggacatatctgttattaatcagctgtgtcaggaaataacctgagggaatatttacccagtcaaatctgaagaacaatgatttataacaatctcaataaacactgtgtggccatcaattgtgatgatgaaggtttaacaaaggtattgggcatgtgatagaaggcttacgtgctgtatgtttcatctgtcataacattatgtgtttaaaaaaatagctatttgccccattactccgtgtggaaagccattagtgggtggagggacaattgggacagcttgaatcagtgacagatatttaagttgaatttggtgggcctactttcctgagactgaaaagctagaaattggatatggatggctacagaaatttctgtgacatacccaaaccaaagtccttttaggagtgactactattcatatgattttagcctagtcacatttttgtgtctcatgtgtatttcccattaaagctgctatttctcaatggcaacatgtctggtgggccaaggggcatgaatccacttgaaataaaagaaacttctattaggagaattaggaactgggctagagatacctggccaggtagaatttgctttgaatgagaaatgataaactgacgagaaagacttcctagtgcaagaagcgcacttcaagggcatccaattccaggaggaaggatagggatggcaagctgccaaggttgatagctggagaatggaaccaataattactagaaaacggaacctacgaggtgttctttaatctctttagcatctgactgagagaaaaccattctttccctagtgggtaacagctaaacaagattacagtatttcccctgggagatagatgggtcatgttatgagacctctcttgggcactaatatctgtcaaaccatataaactgagaaaattagtttggccatgtcctcaagacgtcttaaactcagaactaacagagacatggcctctaacctatgtgaaaaataatacatggtatatagaaaaagtagatttttgtaggacagtggcaaaataattacactggcctctcgagacccccttgctgtggaggcagcctgtggctgtggatccatatcctgacagtaatgctcttgtaatgtagccttttctggcaatagagcgcggatttgtaagccatgttattgtgggtcctgagagtcttctttagcaactgaagcctatctaatgtcacccttagcgcaccatcaaaaggtgaggtgcatttacagagaaggcggtgcatttttcacctggtttgtcatggtgagggcgagtccagaaactgtgactattcacacaactccagcctgtaccaaatctctataatgtgtgctttagttgctgaatagaggcaaaatgttctctatttcttactgtttgcagaatatttgtcacacttatcaactgcagtatatttagccctatggtttgggctctctccaacccaccacacattattaataaactaaatacacttgctttgttaagtgcgtttttatttctgctcttacaagttggctttttaattttagaagcctcacacctgtagaatgtcatcagaactacaaagggagaaagaaaatgcttaaattaccttcttcataactttcaatggagtatcagctatatgaaacagtttataaatccttcttaccaagattttatctttgttcctgcttttctaccaagtttcattttcatttccaatgtgttgagaggcagtaaggagtcatgcaacacttaactgattacaaactggggacattataggccaacggtgatgctctccacttaaatagtgaattctctatagtggatacaattgggttatttggctttctgcaatacggaaacattgatagggaagtgaaaaaaaaataagatcaagtgcttaatagaggtggaagtgcatatttccaaggcatctgtaattcaaactcttcactggcaccaggaaatcactgagataacatcattaattttccttaaagttagagttggtagaagtggcctttggtagggaaagctagccagggcaagttttatttgcctgtaccgcagacaatagctctttatcatggctttgcaggcttagaaatgacaaaagcctggaagctaaatctaagcaaatataaaattaggagaaaattcttaaatcatatattgaaagtaagtaatgtgaccacacatatgttcaataaaaggatggggtgaactcttcattctatagttttactatatatggcaccctcctagcattaatgagaattcaatacttaatttagatacatacaccttaattttggcatacttgaatctttttcacatattagaaaagccatgctcagaaaggaaatgcagagaatttcaaattgatttaaaagtgaaaatttaaagaaattattctacattcggagcttacctttattacaaggttatcacctcaaatggacaaaattttgtatattatgaaattcccccattttcccaaagtttattggaaattataagttgaaatgacagacaataaaacacatatgtgaatggaattttttttgagcaggaaaatcgaataatgcctaaatccagggtgaaaatggacattatagaaaggaacagtcattataaggtttttccatctggtctatttctgggtttcttttttttttttttccatagtataaactggaacaaatggttagcttctgaacttttaggatctcacaggaatattctctagcacttcatgataaccagtgcctaattactcctttattaaaggaaagcagtagctctgggatggggcaggggcaggggcaggggcaggtgaagaaaaagaggcaagaaaactttctctattcagccccctgactcgatcccatcccaaactactttttcccagctatgacgtattaacaggtcctaaggaaaccctcgacctggaaagccctttaaacaccagttaaacttggcaactatatagctgaaaaatgataacttcgggctataaggaaatggaagccttggtttactttcattcatgcattcatctcatgaaaacatattgaaccatgctgtgtgccaggttttgtactaagcattggggataccaagatgaagggaaaaggcctagtctctctttccaaataattccacttctaaggcatttcttctctatctctgtgtaagaaccatatgccaagtgactccttgactatcttattgctagcctctgcagatcctctggttgaacccctttatttctgaagacctggcagccagggttcacggtccttctcttttgcccagttctcgctccaattctgcatgatttcaacattggcatgggggactcatgcatcattctagcctctcagttccttaacttgctatttcacctccatggaaattcacatccactctacctctgccacctactcaaatggctatatcctagatctaatcacctgaaactgttccaccttcaaaataatgttcatctatgattctctctgaccacaacttcttgaccttcagttcctttactacttcttcccctacctccctgaagagttagcattttcatccctctacctcctaattaccagtttccatatgcgttcacagcttctcctacccaacagggacttgtcagtatcattttaatcaatcttttgcccaaatcctcacttctcttgcccagctgttccctccctaccccaggacagaagcatctggctcccaagtgctaagcgtgcctggggaaataccacacccctgcagattggagctaccgtgaaacactcagccgcctctgggttcacacagctggttttcaactccgccctctctcttattctccacaaagataagcccaacttcatcatctcctgctgttaactgcgttgcagggactctccactccatacaaaaaatggaagcctttatagtaagacatccttcaccttgctgctacctggtttcttagttacctggacctgcccagatccttccctctaccccacccattacagtggaagagaggtatctcttccctcccttgggctctggattacctgcccgtattctctgagaacacccattatttatcatctcctcttgggccaataattgtaatctcaccctgtcttctcatactcatataaatacattcccacgaatactatatgtttggcctgcatttgattgaaaaaaatccacgtaagttgacccaagcagttcaaacccatgttgttcaaggatcaatgtatacacacacacacacacacacacacttatatacacatattgtgccacataatgacatttcagtcaacaatggactgcctatatgacagcgagcccatgagattacactattatatatttttactgtatctttctatgtttaaatacgtttcgatacacaatacttactattgtgttccaactgcctacagtattcagaacagtcacgtgctgtacaggtgtatagcctaggagcaataggctatcccatacagcctaggtgtgtactaggctataccatctaagtttgtgtagtactctcctatattgacataacaacaaagttgcctaacaacacatttcttagaacatatccccattgttaagcaacacgtgactgtacatacatttccattaactcctcagccccctccaactagctaccaccccactcttctccccttcataagtaaatttctccaagaatcattcataccttctctaattctccacttttggttcacttttgaactcaccacaccacttccactgtgcctctaaaatctcaccaaagttactagggaccttcctgttgctaagtccaatgggcattttccgcaactttatgctgacatcccagcaacatctgaccctggtaacgggttctttctttcttcccatggagcatgtggcatcataacctcttggaattttccttctttcctcctggccattcctttgcagtcccttctgtaggttgcttatcctgtgtcctaaataacttcccttctcacgctacactttcctggagctatccaatcctctcccccgttacaagcagcacctacaggctcatgatccctaaacgttgtttgtatatttctcctgagcaccacagctccgtgtctaaccttaccagacaagtcccacattcacctgatattccaagccaagcacctaagtgtcttccttgactccctttcacccaccacatcaagcttgtccaacctgtggcccaggatggctttgaatgaggcccaaatgaattcgtaaactttcctaaaacatttttttttttttttgcgatttttttttttttttttttttttttagctcatcagctaccgttagcgttagtgtattttatgtggggtccaagacaattcttcttccactgtggcccggagaagccaaaagattggacatccctgcaccacatcaaatgaatcactgaggcctgtcaaatccacttcctaaatatttctaaattctctccacttatctcccttactactctgctaattcaagccaccacattgctggtttagattactgcaacaggtttttctcctgtcactcccacatcgcaccaatccatactctgttccacagcaagaatcatctttctaagcgacaatctgattatgtcacccccaggccaaatcccctgacctctaaattccttaacttgggttttaaaaaccttgcacaatctgcttcctgcttctctctccagcctattatttcacaatagatctttcccctggaattctgtgctttagccatactgacatattttcagttcctgaatgtgtcatgctttctctgggcccttcagcacatgctcttctttctgactagaacgctcttcctagagagagagctgcttactcttctagagttacctagcttagacatcacctcttcaaacaaacattctttgaatctcattccacacagttagctgttcacatagtaccccattgtcccactgttgcacaactaaatatatgacattgaaatggtcttggaaatagagacaagatcactttatttttttaaccaactgtagacattcttaatacattatacatatatttgcttatgtctacaaatttcatgaacatcctggttatcccttgttagactgtaagttccatcagagcagaaactgtgcctgttgggccgggcgcattggctcacgcctgtaatcccagcactttgggaggctgaggcgggtgaatcacctgaggtcaggagttcgagaccagcctgaccaacatggtgaaaccccgtctctattaaaaaatacaaaaattaggccgggcgtggtggctcatgcctgtaatcccagcactttgggaggccgaggagggcggatcacaaggtcaggagatcgagaccatcctggctaacacggtgaaaccccgcctctactaaaattacaaaaacaaaattagccaggcgtggtggtgggtgcctgtagtcccagctactccggaggctgagccaggagaatggcgtgaacccgggaggtggagtctgcagtgagcctagaacgcgccactgcactccagccagggtgacagagcgagactctgtctcaaaaaaaaacaaaacaaacaaacaaacaaacaaaaaacaaaaattagccgggcatggtggggcatgcctgtaatcccagctacctgggaggctgacgcaggagaatcacttgaacctgggaggtggaggttgcagtgagcccatattgcgccactccactgcactccagcctgggcaacagagcaagactccatctcaaaaaaaaaaaaaaaaaaaaaaaaacagaaaaaaagaaaaagaaactgtgcctgtttcatgggcatatcatcaatgcacacagaccctcagacaatagtagagttatacataaactatttgatgacatgatagagctgtgtaacacttcaggatttttccacagatgtatgataaaaaaggaggaaagcaattctgtcatttttcctctaccacttcattcatctgcacgttagcattcaagctaataaaccacacatgtctatgaagtttggtttagatcagatagtcatagtcttctaatactaagtacattttgtaaaaagaaaaaaaaacaaaggtagaacaaggattgtgcaagtttcacaaaggtaattatggatgccgatgccaatgccagtagttggaaaataaaaattctcaatatcttaattcaacatcagtagctgaggaatggtgacaggaatgattctaaaaataaaacaaaacattctaggcaaactctaggccaaggatacattaaagaatgaattatacattgcaacaggaattgtgacagctgtttctcccctctctaagtaaaaatgtacccaacctactttttattctaagcaaagacatagtatcaagatcttcaaatactggccaatacttacagcaaagggccttctgcagtcttcggagtttcatggcagtcctataagctgagaatctgacattattcaggtcagctgaaaagagggaaaacaaagagcatttgttattccatcagaaataacagacaacccacccccgacgcccagtgatttgccaataactacaaccaccacaaaaatagcctagaaaacatatagtgtgtatacgccaagctttcggaggtgaaaattctgttaacgtggggaaaagaaaaaataattccttttgccctttgacaaccaggaaggctaagttctgtgaagactaaagtggtatagcctgaagggcattcatgtagtcctgttcccaagaggaaagagatggacaggcattatttttttctagaaagtaatctggatctactgtagtgaatcttttctgcacaagattaaagagaacaagaaatacattatttaaatagctataagaccttaaacaatcaagtggcaatataacattttttctgactgtagaagttatacatgctcactttgggtaacttagacatttaacatatacatatataatcaaataaatcatccacaagcccataaactcaaaaataggcacaactggctggattcagtggctcatgcctgtaatcccaacgctttgagaggccaaggtgggaggactgcttgaggccaggagcttaagaccagcttgggcaacatagtgagatcccatctctacaaaaaaagtttatataaaccttttaaataagcactgttaacattttgagtattttttatccaacatatgtgtctatgtgtgtgatatgtatttaaaaatataattaggaataaaataaacatttggctctatattctaaggtacaatcattctaatgttcagcacagaataacaacaatatatgttactgtggtttctgcagtcaccggtctatcaagccctgactcacgccacctagcaggaagctatatttagatgatgttcttactcaagtctgcacaagccttgatagatactgggctacatttatttcaggaactcagctccaaaaagctccttgaagacaagaactctgtcacctacttctgtcatttttcctagcaacttaatatgcaactgccctctgaaaaagctgttttaatacagatcatggaccgactgaccaactgaatcaataaacaaaagaatgaaagaaagaaaaagtacactgacatacatgactgccataatcaaatgacacctacgaaaccaattctgatgaggtgttaggaaagggcaataattcaatccatatccaagtcacttgggtcaacattttcagctttatggccatcgcagagaccaaacataaaagcctgaatttcaactaggggaaagaaaacaatgtctgtaatttaaactattcagcatacaattttgtttaaaagaccggaataccaaatgttggtgaggatatggagcgactggaattctcagacactgcttgttgggaatgtacgacaactttgggaaaccagttaggcagtttcttatgaaattaaacacacatgtatattatgactcaaatattcttttcctggatatttgcacagaataaaaaaaaatgtatgtccacaaaaagatgtgtacatgaatatccatagcagctttattcataatagtcaaaaaccggaaaccaaccagtaaggtaatggataaacaagttgtggtaaagtcattcagtgggatactactgtgcaaagtgcaataaaaaggaactaactactgataatgcaacaatgtgaactgatctgaaaaacactaagctgggtaaaagaagccaggcacaaaacagtacatactgtttgatttcacttatatcaacttctagaacaggcaaaacttagctactatgccagatggtagcctggggtgtggtgggagtaggtaactgacctcaaaggaacacaagggtgttttctaggtgatcgaaatgttatatcttgattggcatggtggttacacgagtgtatacatttgccaaaatctaacctgaacacttaaaatggaaacatgttatagtgtttaaattatgccctgataaggtaaattttaagagtctttaaaaaccctcacatgaacagtacactctgatgtatgtgtgtgttagcttaagctacactgtagaggtggtcagttgtcttaatcaggagtgaactccaagggtggttggctagcaattaatcaaaaagcctcatgccacaggcggccactgtaagtgattcagttatatttagctcttattacaccaggggtttcattaattttcctaattaatagttagacgggcctgtgtagtgatattagtggtttgcaaaatatgaagattgttgaaaaacatttagaaacactccctgcctttaaattgagtttaagaagaatccagtaggttctccatctttagaaatggtgccctaggctgaattccaaaatgtccagctgtggttcaccggattcttagttgccagaattcagttagatggttgagggaatcctgctgctagaacaatggttttcagacttgagcaaacatcagaatcacctggagtggatagtttaaagatgcagatttcctaggccccacctccagattttctaattcagtaggtatgggaagggcctgggaatctgaatttctagcaagtttccaggtgatgctgatgctgctggtccagggaccacactttgagaaccactctaatagaggactgtggcctgtgtagactgtgagcctctcacaccaagcaccccaaaagacagaactgtgacttcactgtgtctctggcacaggctgtaagattgttttgtacccattggctaataaatgctcctaagtgacagaacttgtactgagacttgctttctttataacctggcagccgagaggtagttaagagggcagtcctcaactacatctaaccatgaatgactaccaacaccaattacagagaacctgtgtgagtccttgttagtcaaagtgtgatttgaggaagaatagcatcagtatctgcttggagcttatgagaaatgcagaatctcaggccccacccagatctgtgaatccgaatcaatattttactaagagcctctggtgattcatatggaagttctttaaatgaatattttaataaagtttcttgttccgtgttgttaaacttcaagtataaattctgtataccaacaccatcctgtgttgtcttttgtttttctatctttctatcttccattttgtgggcttttattaatagattatttaataactactatagtcaactacaccaaaacctcccctctgggatatatttgtgagtctcttgtttatgataaataccaataaaaagtattcaataaattaaaagcatctcggagtatcttgaaatgctatatatacagattgcttcttgaagataattaacatttgcctggacgctgtcctttagtgagcagaacttgatctagttgagtccctttaattgtccttctctctctctcccctaaaagatgtggttcttcctttgtctcttttgcccagtcatcactgcttacttttttaagtggtctcagccaactcatggtatgaattgtcttgcggcatcaatccatgagaaaccaattcctgtcctcccctccagattggtgcaacatccttcaccagtaccatcaaatttttcctgtacttgctagtgtggagttcccttacacacacactcatcattgagtccctttgactctttataaaaagaaatgtagagacgtggaaatgcacttttggtcaaatacagatccctttcccattaacaccagcctgtagcagtttccaggggataagcatccaatcccaaattttctctcattcctttacttatgcaaaagtattgagtgttagttttgtgccagccaaacatcttgtagaagatattggcataaagtttctcttctttttttccctttctaatcctccttctccactgcctcgtaactcatgtgcctagtttcctatcatctttcttctttcaaagaacgacgattcctctcttatgaccccaattctaccctcttttcctattttcctggttctattcagcatttagaacaaatggtctaaatgaggtcacaagctccatccaaatcttagcgttcatatcaagaattggcaaattccagtagctagagatccaagtgggagaggcaagaatgatctgattctttcagggcatgaatattagtgtggaacagtatcagagttcaaactttcttcccttctaaatacttctaactatgacacattctgcctctagttaatcctccctgacatcttttcagcctacccccaacccactgcagtgaataagccttctgctaccagttttccacgcaccaaagtccaatccattctcaaacagtgattcaggcataccagaagaaagtagcagggaatgcctccagctttgttcttttggcttaggactgacttggcaatgcgggctcttttttggttccatatgaactttaaagtagttttttccaattctgtgaagaaagtcattggtagcttgatggggatggcattgaatctgtaaattaccttgggcagtatgaccattttcacgatattgattcttcctacccatgagcatggaatgttcttccatttgtttgtatcctcttttatttccttgagcagtggtttgtagttctccttgaagaggtccttcacattgtggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggagtgggggggatagcactgggtgatatacctaatgctagatgacgagttagtgggtgcagcgcaccagcatggcacatgtatacatatgtaactaacctgcacaatgtgcacatgtaccctaaaacttaaagtataataaaaaaaaaataaaaaaataaaaaaaaaaaaaaaagaaagtagcagggcaaacgtttagcttccatcacaatgctacggaagccatacaaatgtatatctggtaactgtcagtgaactgcaacggagttctggtgccctacaagtctactactcaagagagttaactgcctgtgttgtttgagtccgcatgtgttgctaggagtctgcagcaccactccctccggcttacagctggaagagataagtctctgccttaggaaagtgtgtaggatgcacacagaaacctcaagatgcaatacagctgtgaacaatgtgacactgtcctgggctaaagcttgggatgactgtgtagtgaaagtatgtatgcagtttaataaagctaaagccccccattcccgtgccccatgagagactgtcctccactttccctgggagctgactttccaggactctgatccaagttgtaatgagctcactagctctcacagccggaactcaagaggagtgagactatccaagaaaccagttacgccatgtttccatggcagctgggagaaagcgcacttcagaagggtaaaaatgctgaactgcacatttctcttcataacttgtattattttatccagggctggttctagcctataaatagagaaatctagaaacgtaaggaacaagggcaaacatcaaaccacctaccttctcaagttgaatttccaactactgaagtgataggccattcatcttttattttgaaacatgaaacaagtaataggcttctcttgcccctttgtttagtctatgcatttttcttgactttggtaagtatttctgttttatgactttcacttttactctgtgtaatagtagcaggtgtcaaaattcaccagaaaagaggaacaactggtcaagtttgcgtcacatatctacatgttacatgcttttgaaaaatagtgagaaacacctcagcattttaaagccatggaagcattccaaagatattacagaaaaaaaacattaagtcccttcatttcaattttatagctggtttctgtctttttaataatactgcaaaaatcctactatctctgactgaactgaggtctagaatttaaaacaaggagtgttttagtctatctttccaatggcttatggagactttttggaaaggcctaaggtttcaatatgcctatctattagctagaaagaacaataatgacctcattaactttatgagtggaaagagctgtacggctaaatgattattccaacagataaattggtatagtggtctttgtttcttcataccaactctatttcccagaagaaatttaatccaaatctcccaggtggtaagtgaaaaataaaatttagagcacatatgcttttgggggagtattgttctaaattcagtgtttggcatacaatacgcattgaactactactgcctgcctattttactaattttccaaattttcccaagaagccaaaacaaggcagtctccccacatactcctattatagaaaggtggcatattttaaaatataataatatgtctccaattttccagtctcactcctccaaaggattctaatggacttttcagatgacaagtattattcttgccagctcaaactcactagaacagacaagaaccttggatcttaatgagacttcagacaaattgagtaatttaaatccagtctgtcttgaaagcaaattaagccaaaatatccaggcttcagaagtctagaattattgggagatcttcaagaacagaccaggaattctggaacatatctttaaagaattagctgagagaagaggaacactaacacatcatacttggtctataattttttagatatatttgaggcctcttaaaatctcaactcgtaaaaacctcatcatcaacatagagctttacttaaatgggggaaaaataaacctacacacagataaacaggaattatgcattcatacttagataagtacagaaagtacagtctgtgaatttataattactatcaagttatgtttccagatgtgaaatggtattacttatttatcaccaatgactttgtaaaactcttctaagaaatgaaggagagggccaggtgtggtggctcacacctgtaatcccagcacttatggaggtcgaggcgggcggatcacgaggtcaggagttcgagagcagcctggccaacatggtgaaaccccgtctctattaaaaacacaaaaaaattagccaggcatggtggtgcacacctgtaatcctagctactcaggaggctgaagcaggataattgcttgaacccaggaggtggaggttgtagtgagctgagatcgcaccactgcacttcagcctgggcgacagaatgagactccatctcaagaaaaaaaaaaaagggagagaagcaataaagtacctagtatggcacaaatgtggaagactcagaattgaggaaaagagaaaaaggttatgaaccaaaaaatactgagaagttcaactgtgaaataaaagatagcacaaaatcctggctgtggattgtttaaggcatttctggctccctcctcttgcttggccttcctcagcagaatctcactacttcttagcaacactgtaataatggcagagttgaaattcaaattagttttgctcattgttagctgccctggtaaaaggtttgttgagaaagcagtttctgtaacaaatggccgatataaagttttctgggggagaactgtgtatcttaagtaccatttctggggcctgaattctgccccagataatggagggctgactcatataggcaccactgtgccatgctcctttaaatcaagcttcaagagcggaaggatcagggctctaactcccaaaaccttcattatatataaaacatacaatccataataattatggatccataaggataaatgtcttctaaaaagctacaaagcagtgttgcctgatcttttaaaaatcattagtattattttaatatataacatatattattttaaatacatttaaaatagtacaaatgacatatttaaatacatattttatatatttataacatatgtgtatttaaatatgtatttgaagtaatactactgattaaaaaagactctttaggcagaactgttttataactgcttaaaagacattcatctatccataatcctttcatctatcctttcaatatttattgtgcatgtactataagccaagaaccatgccaagtacatggaatacactggtaaccaaaataaatctctgcctttattgactttgcagtgtagcgaaggagatggataataatcaaatattcatatgtaggccaggtgcggtggctcgcgcctgtaatcccagcctttgggaggccaaggcaggcagatcacctgaggtcagaagttcgagaccacctgggccaacatggcgaaaccccgtctctactaaaaatacaaaaaattagctggatgcggcggcaggcacctgtaatcccagctactacctgggaggctgaggcaggagaatcgcttgaacctgggaggtggaggctgcagtgagccgagattgtgccgttgcactccagcctgggcaacaagagcaaaactccgtctcaaacaaactaacaaacaaatattcatatgtactgtggtaaaatggtgaaggaaacacacaggaagtgatgagactgtatacatagggaaacataggtccgagaggcttcttggagaaggtgacattgaagcaaagacttgaaggatgatgggagcgtgccaggtaagaacacagcagcgtaataggtcagcacatgttaaaaaaaaaaaaaaaaaaaaaaaaaagctctgaagcagagaagaaggtggggctttaagaatccttagaaggccaatattgctgaaatctcagagaggaaggaggaagagtgggcacagataaggcctgacaggtaggcagggggaggcccactgcagagccctgcacatcgtgtgaaggattttgggtgttgggacttctagttaaacacagcagatggagcagactcatttgtctctctttatccctgaaactctaccaggttgatagaagaggaataaaaaatggcatttacccaaaagaaaattaacaaaacaggagaggagatgagaacagatcagagctccagtattttggtggcttagaaaatgacctgctggtaaccaacttaggagaccagagaaatcccaagctcaattaatgatgttggggagacaaggagattggggcagggagtgggaggaactaacaagacgcatgccagtttatgtagccaagaagtctcagaaatgaaaggctccaggttcctctgaagactgaaatgtggctgaaaatacaaggactggttgaaagtctttagagccctaaacacctcccccacttggagcctagcatctcagccacctgctgcttcatcctgacagaaggctggaggcttaatctcgaagctgcaccacacaccagggcgcatgaggagcagtgaaatttggaagtgggagaaggcactggaaacagagggattacataccagctctgcatcctgaaagaaagtaaatcttcaaattcatttccttcatttcctactcctcaattccatatttagtctgctgttttctgttaactcattttaaaaagctcttctacctaagcactttcttttttgccacctttatctccagaaggaacttcaacttcagcaaggtatgcagccattaaattgttcctcaattatcatccctatatatcatattcttcatgctgcagttacaactactccaaatcaaatcaatgcactttccttgcagtctccctcttgacaggcgacttacagtcacacaggccactctggctgctggaataaacaatactattctcctcctttggctcagaaccttcagtcactgctctctcctgtttttctcagtcacaacatgggtaactcagctacttacagaactctcagaatgacacaaacttataaatttaccccaatctccttcaactctattctcaacctcattaattaacgaatcttaacagtctctcttcataagtgaacacacatcccagattcgccagggcagagccagtttaattaaattttcctctttgttataaaaggtaagactctaaaaatgatcagatgtgacttaattcttatacctttgcaaagccaaattcacagatttttttttttaatgttgtgccttagcttttttggattgcaaaaacatactcttcataatatggttgacattacctattttgaatttatcactctctcttacagttgaaaaatttgtggaaagcgtattttaatgatgaaaataaataacagtaaatttcctcatctgctttaacctcatcttttgccccttcctgttttaaaaagtcttaacttaattttcctaaaggctaccttttctaccttggccttaccgccgtctcggcttacttatttctctgcccttatctcccaagatttcaacatatgatctttctcccaaaactccatttcaattacttctctggtaaccacagaccagaggtcaccaactggttgaatttagtctgcagactctttttttgtgtgtgtgtgtgtttgattcgttggtcagtttgggctcacataatggtttttgaaattgttgaatgatacgccattagttaaaaatctggtgatttcccgttgtcttgcttctctggaagaacctgaagacctgacaatagagactcacattctcatagaacagtcagctgcaacggaggctctgttaccctaacagaagcttttcaggttgccccagttcccacccagtcaccttcagtcattcaaattaccagcttggccccaggaggcatttcttttcagatctttgcctcagcctgaccactcccttgttctcccaaaagcttttacatttacccttcagttacactctttttcaggtccctgtcaaggctctgactgtggagtccctccaataagtagctattacctggctgtcactcaaattactctatggaaacagttgttactgggttttcccaaaactttccagcgattaattctttggactccaccttttactaatgcattcaaactaaatgattgtgctgccaaaaatattgccttaatacacttactgttgcagtacaagaacaggtaggaagacaggccaaaatccatgagtctcctgactatatttcattaagtgacaattacttctgcatttaaaatcatcagttgacgcttacttaagcacctattatatgcctaactgtgtactaagcccaggggttaaagattcaggtttctaagatattggggaaaacaaaaagattattcaccctgtaaaaaatcagtacacgtatcccaggtatttgtgatgtgtcaagcaacacacacatacaaaactctggttatgtgagtgtcaaagaaaaaccagagatggacggtaaagtggtaaaaacagattttattcaggaatattgcaatagtgggaaagagacctcagtatagaactgggctcaactctgaatacagcatggacaagtgggaattgatagccaaggagcagggtggggtttggtggatggaaaactactaagagaaagcatgggggtaagggggattctagctaaaaaaaacttaacaggaaccttgctgaagacacaggccagggtgatcagacgtcacatgggggatggtggaggatgaggaacctgatcagatacataagaggaaggtggttcttgctaaactgatttagcaggattctcgctacagctggatttttacaaagaagtgcacaggtgggcctaggagaaggttcaggagtctggctgaagtttgatcaagtagacaatctttatcatgaggatgcttatgtacatacagaaacatataatgaaaatagaccatcgtgcagtttatatgtcaaccgcaaaggtagtttccaagatgacataagcagtattccaatgaacatttttaaggttaatggcattggaaatttcctacataagccatgttactcatgaaacagtaatttctaagcccacaaaggcttaaatttagtttaaatatccagtatacaataaaaataaaatctatagtaatactgatagaaatgactgatgtaactaattagaaatagctttatttttcattcttatacttgagggaaaaaagatgagaaaaatgcagacttctgaagaggtcatgttgtgttcacttatccttggcatctagggcaataaatgatggtgctcaataaatgtatttggaataaaattagattctgaaaggaacttccttgcttttaccaggtttaagctgtcgatgacattgattttacatctaatttttcttcaaataatataattttccacttctatggctgaatcactggaattattatttttgcttactccttacaacctgagctggagcttcttttttgaaacacacctcacaaagatatcaagactttcctaaggaataaaggaattgggacaaagagagaaagaaaataaatggtctaaaaagaatgcttatttgcaaggtgaatccgctgtatttaattgtggcagataactgtatgttggctcactcaacaccccttcccaaattctttctccttggtctttctctgctacaaaggctggaggatctcaattccctgatccagccaggggaagctgtgtggacacagttttggccaatgcttgagaagatatctgcaagaaaggatttcccttcccaaatggaaagacaaagagactctgaggctgaacgtcctttctctttcttcctgcctgagaagcagcagtcgtcttggaaccatcaggaccaaagtcactcgttaaaaatggtacagcagaataaaccatggcccaggtctctgatgacatcacggaactcttccatagctctcaactacctgcctccagacttcttgttctacaaaaaatatcaactcctctgtgtttaagatacaattggtcagatattttattaactgcaaccaaaagtcatctctaactgacatgttaattgaactgtaagcaacaaaatgcagaagactaaatagggagcatcgtccacccccgcaatcctccttgcggtggagaaatgacgtgagcactaaagagatcttgggtggcagagatctccatccttgctaccaggtggtgccactgatgcagaacagcttgacagctaatttaacgtttaaaacaattttataacagagggcttatatgggtaaggcactcttctagacaaagtctgcaaagtgtttagccatttgtttggaatgggacgttcacaagtctgattctgcccagatgtaagataaggattggaatttaaaaacatacaagttacttctctggaaattcacgtgtcaacctataaatgaacacatataatcaactagtttttcattaactctttagagttaatgaaatgttcataacttcatctctagtgcaaaatttcctctttatttatagctcttaagataaatgttatttaaaaaaatagttttggtaacttcaactaatcatatgttttgacagtcaaattaagattcttctctaccctttatctaacagtaaacattttaggttctgagtgaaaatgatttgcatcctccatctgcctctttccatttctctggtgcccaacatcaacacacccccaatatccatgccctctaataatcatcatgaataaaatggatgccaaaatgaaccacagtagaaattaaccttagttaccatgggaaaagcaaactgaccttcttgcaaaaaacatttttgcaacatttctgtcttaggctggtatgcatgctttcacctcattaggaaagatacattgtttgggttttgttgatgttgctgtttgagaggtgcaagaagagaatctgttgagtctttatgcatgaataatgagtccaagatagaacacaattcaagatatttaagcatctaggatcatagtaaactatgcgtatctctgctttttgtatactctagcataacagaagaggggaacaggtggtatgactcaaattgcccatgcatgcagaagcatgtgatagagaatgttttcttttcactgttatgtgttaacttttctggagactagatgctaatgatgagatcctgctgaagacactaatatgtaaatcattccttaaacaaaattacttagcagctgcagttatgataaaataaatcaatggtaggagattttcattagataatggactgcctggccctctgacatagactgaggtgcttttaataaaggatgcctgaagcgttcctgtttaccctctgtgtatctggacaatacatttgaatctggaaccaatattaccggtactccgggaaaatactctttttattttatttttattttttttagacggagtctcattctctcgcccaggctggaatgcagtggcatgatctcggctcactgcaacctctgcctcctgggttcaagtgatgcttgtgcctcagcctcccaagtagctggtattacaggtgcccaccaccacgcccagctaattttcatatttttagtagagatgaggtttcaccatgctggccaggctggtctcgaactcccgacctcaagtgatctgcctgccttggcctcccaaagtgctgagattacaggcgtgaactattgtgcccagccttgaaaagactcttctttatcacctcaaaactatgctgcatttgggagttgcttgatataaagctttaccaatttgaagattcaatccaagaatcgggcagactctgagttcctctgcccacctcatggatggccctgaagtcacaggagtgagtttgccttctttctcctctcagtggcaatgaccacggattccttgtcttttggattgcctcctacttcatagcagacagggctcattccccctttctctgcctctctgtttctctcacttctcacctcagctttcttttcaacacactggatctgacccagcttttattctcctcagaatcctggacaaaactacttgaggataaacctaaagcagcccttttttcctaagatgtaggtgactcttacttcagctctttttgtatgcaagtattccctgtagagccaaagagaaaaacggaagtgacaggccgatggcagaaggaatactaacattcgctgagcactcaagggcaaatgtcgtgtgtacctgataccatcgagtccttacaaggccctgagttctgtattatcagctttgttaaagataaaatgaggctcacaaatgtttggtaacttccctacggttgcatcccagagcctgcattcaagaccaaatctttctgacactcaaagcctctgatggccttccccgcttctccgctacagaacaaatgtctttccttacccagtgtaatcctaattagcacaagggtgaatgggcagtagtaccctcagaagaaccatgataccgggcaaggagcagagggtatggggtgaggcagaaacccttgcacaaggaccacagggagggaaactgaccagtcaatgggatgagggagtgaccaggaatgtaactagaccaataatgatgaagttcccagtcctccttatctagagaagtttgctgaataatcaacacctgcagtacgagtttctaccatttttcctacaaaagttttttgctcccatagaaacatacagctgctttctatttacatggtgcagtatatcaggcactctgagggttaactaagattctgtgacttagggacctaaccaccatttataacacatttcattccaaattgtatgcaactgacttacaaataaacttggaacagagcccgagggtaagtttggaaaggcctaaatcttgtctcaaggtgggaatgtggttcttgcctgactgctgagaaatttaatggttactgggcaaccaggaattaaataatttgggaaattttaactctacctttttcttatgagtattctttaggggaatatatatactttttattaagaaaatgaaatacatggtgccttagaaatagaatctctaatttaaaattttcattttccaaatgagagaactaaggactagaaagctcttagtaacttgttctgaattccctagtcagctaggagaaaaacatcaactagaatccaagtctttttctccccaagtgtgtatcccttccctgagcaagccacagaacaaaaatataaaggctcattctaagtgggacttcaagtctactcattcagcttaagggctcccaattgctcccaattcgaacagagggcccgtgaatttctttaaccttgacaaacatctgactggaaaacaaattttcccaaaagcaagcagggtctaattttcccctgttaagagtggtttctagaccttggcatcttcttaaatttttaagattcagctcctcctaacccgctctgacatataaagtcatagtgttgtgaagcagactgtgttatagaaggaagtcaggaagtaaggatgtgaacatttcttttaaagagtagcagcagcctccatcctgaatgaagaagccaggtctcagacactcccttagacgtgccgcctttaagaaaggacatcctctctgtacttctgatgatcagcttaatttcccatttgaataatgatttttttgtttgcttctgaagtcatgagaagcagttagcatttatgaagctttgaatggttgtccaatttgacttaaaggccacgagatgctgatgttaaacttcgtacatttatttctgggttcctgtcttattaaaacactgacataactctccatagtgcaagttttcattcaccatctgtcagtctattgcgctacaggaaaaaaaaaactccaggttaattatgtaaaaggtaatagcatcaaagaacagaacattgtgcctattatactctcaatgtgcaaaaatgggcatatttttatgtgtatgtttgtatatgcaaaaatatttacagaagcaaacataaaaactatactgttaattgtctctaggaagtaaaattaggggattgataccaagagtggttggagacttacttttcaatactatcctcttacaatgtttgatttcttaaagtcatgtgcactttttttaatgattgagtattaaatctatctatcttcttttcaagatttctctatctgggatttcttccaaattcttagcttcacccgctgtccttcaggagagtactattgtacaatggaaaaactactgggtagagaagaaaacttaatgggctctatttatgtctttgctgtaaaataatagtaataatggttatcatttattaggtgcttaccctatgtttgcaataaataacataaattctcaggttatcatttattaggtgcttaccctatgtttgcaataaataacataaattctcatataattaccttcaactgtgatatcattatttcaatcccattttataaataaggaaaccaaaggcctaagaagtaaaattcaaatccatttgaccctaaagcccttcctcttcatcactatggtctcccaataagcttggtctagtaaccttaactttcctaagcttcattttttttttgttcatttttaaagggaacagtaatagtacctattcctagggctgttgcaaaactaagagagatagtgtatctcaaaagctccaaagaggagatgtatcttggatatatacttgctcagtaaaagttaggaacctttctctgcccctgtacttcttgttataaagtataataaaagtgcaagtaatatttttatcatgctgtggaccaaactctttcttcggttccccttttcaaatggctttagagtatttcctcttcaaaatgccactgtcccctctcaggaagaaagtatagctgaggggctaaatcgctggtttaggagttaaaagtacacgtaaatccctgctttgcaatgtgagaaaattacctattttctctgagcctcatctgcacaatggagatacaaatatcttttacagggtttttgaaaggattaatgagaaatatatgcttatggtatggcagcacatacatttatatgagccaccaaaaataaatttttctaagaagagaaattgtaaataaacccataagtatgtaattcaatcaaattcatatctattccctgttgctccgctcagtttgcaatttcctcttttcctcaatggtatcaccattctctgtgtcaccacgccttcaaattttgaagacatataactccctttttctttaaaacctgtccaatctgtgattaccttctggcaattctaccttgttaagaaaaacctctggagtcacgttcccttttccttcccccattgctatcctaagaccctcatcatgtcaattacctcaaaacaaaacgaaataatctctcccctctctaactgtccttaaactcacccaccaaattcctattccaaaacacagaagacggacttcattatttctcttttctgaagatttaacaatgtttttcccattgccaatcaaatgcaatgtaaatttctcactctataatttaaggcacttagttcaccccaggggcactgaatcagatttcccttttaaaaatctggagtggccaggcgcggtggctcattcttgtaatcccagcactttaggaagccgagatgggcagatggcttgagctcaagagttgagaacagcctggataacatggcaaaaccctgtctctaccaaaaatacaaaaattagccaggtatggcggtgtgtgcctgtagtcccagctgcctggggggctgaggcaggagaatcacttgagcccaggaggttgtggcaccagtgagccatgttcgcaccactgcaccccagcctgggcgacaaagtgagaccctgtctcaaaaagcaaaaaaaaaaaaaaaaaaaaaaaaaaaaatctggagtagattctcagagaacaatgtcttcactgactcgcaaacaagccagtctttcatacctttgtttatgctgctacactatctggaatatcttggccctacattttactttacctgagtattacaaaatttcttcctagaacaatgtttttttccactctccaaacaactctccctaattattctaattaatactgctcttcctacctatataaggtaccatacgtttgaccttaatcttatttaagttggtgtacacggtcttgtaacatttattaactgttttattacttcccaattttatttcccccaaaacacagtaacatcttttgtgaagctgacataggcttttttcaaaggatttcttatacaacaggtagaaagatagcaggcaacaataagatatgtgtgtgtgtgtgtgtgtgtgtgtgtgtgtgtgtcatatataaatttgaatgtataagccttcagtcattccaacctaagacatctaaagtaaccttgaaaagcaaaatgggtatacgttggcattaataaacgataccactagcaataagagaagataaaataatatggttgtcatttgggttctacagacagaaaggacttagaataatgtaagtgttccaccaccggccacaagtagacctggtaccatctccttcactctcataggcaaggaattctatcacatcatgaagtccgctgcatgaccagagtcacgccagcttgggcaatgaacagggatcatgccttatacttttgtgcattctattacccagagaaaggttttgaacattctaagtactccatatttatgggggaaaaaaatcaatgcctcacagaaaactgtaaatgtaaactgaccatatctatggtatacatgagtcttcctcacccaagaggcaggaagcaatcttccttttctgttaataactgaatagccttttattaggacagccactgtaatttagggctctgcatatatttaaaaaatgtgaagaaacaggagttggtatagagaataaaatttaatttaatgggtagataatagatccactaaggatggataaagggataaggcttatttagctgaaaaaaaattaaactgtacagtatttatgtaaccaggaggctgttaccaactagagcccctcaacataacacacaaaaaagtgtgtattatatcagaaaagtttggaagagttgtgtttggttaacttcgttttgttttcacattactcaaaaaagaagaaaaacacccagcagatatttaaaagaaaacatttgtggtcactagaaataaaaaatacacaaatattaacaatgagatggtttaattttccttgttacaatagcaaaagtaaaaataatactccatgctgggaaggacatggttagattggcactttgaagtattatgagtgtaaatggctacagccttttgagaaagtttcaggcagtgcattccaagaagcttagaaacattaacaccatttgactcagtgattccacttacatgaatcaaatgtagaaaggtgttatgcataaaggtgttcctcaaagtcttacgtggaacagtagaaaaattggaaacgactatggaaataattatcagctctatattctttaattgcgtcttggccagaaaatgtaactgaagtaagaggctacaaaagccttaactgacagttagaagcaagaaccttgaaaagaacatgggaactgtacacacaaatgttttgagaagataaaacagtctgctagccattctacctggagagataagttaaaggtaactaaatatttacatatcagttattataaaaattaaaacttacagaaacccatcataaagttgagtttctgtataaaattgcttgctaagaagggcaaagttgttcctgtaattcggaaagtttacaaggatacttgccttgtcaccttgacaccatacatatttggtaaagaaaattttatccattaagatatttgtggtagaaaactattgatttaaattcatagctatatttttcataggataaatgttacttatcaactttctgataactgactgtctgtttttgaccacactgactttattctgtaacatcacttatacataagtagcttgttggacagaaggtattataacactttacttggctttcttctcagaagcttgttagtaataagcctccagattcttaaagatttccttccataaattcaacacgaatttgacttttctttgtcacaattttcaaaaattgggaaatatttttttacaaaagtggtaccccaataaactgcaactagcgaaaaataacatctctgaggaactaagaataagagaagacttatgattacagtaggatacaacactttaaacattctattatctcaaacaactatataaaaatgcataggaaagaagaccggaagcaatcttttaaaatgtaaatagtggctatttctgggtactgagatgtgaggtgattttcattttgtttttgcacttcaccttctaaaatttctagaatgaacatccatgttttaatgttcaataaaagtaagatcataaaaacttctataccctcagtaaacgtttttctccttgatatttttagcctgttgccctaaagtttgaaaatacatggcacgctcttaaatgtttactgaagcaggaaaccaatgaacgaacgaggccatcagcacatcaaattgtgttcagtgtttcctttctttgtcatataaattctgaatccatagtgacactttttacgggtcttatttctccttatcaattaattattccttttagggcaaaattaattccagaatagcagttcacttggttttgctaagataacaaattgccaataaaatctacaacttaactgatattccctattttaattactttgaggctttatcttctactttctggaaagaactccatctctccagagttccatcttgccagtttaataatccgccttagaaaaccctcatctgtatctttccatcttcttgagtggtatttgttttcctcccgagcaaaatcactctcccttgctctactgtgcttcattcaatgaacaattattttttcagaggctaccatgcaccaggcactggtgacaaagatgaggaagacagttcctgctttaaagaggctcattacaggctcatctcattaaattgcactttgctgtattgcactttgtgaaaattgcattgtttacaaactgaaggtttgtggcaatcctgtgttgagcatgtctatggacatttttccagcagcatgtgctcactttgggtctgtgtctcgttttgaaaattccctcaatatttcaaatttgtcattatttttatatctattatggtgaatcgtgatcagtaatcgttgatgttactactgaaattgttttggggtgcaactaaccacacccacataagatggcaaacttaattgatcaacgtcatacgtgttctgactgctccaccgaccagctgttcccccatctctttccctctcctctggccttcctgttctgagacacaacaatattaaaatcagggtaattaataaccctacaatggcctctaagtgttcaagggaagaaagagccatacctctgtcactttacatcagaagctattaatgattgagcttagtgaggaaagcatgttgaaagatgagacagactgaaagctaggcctctcatgccaaacagtcaagttgtgaatgcaaaggaaaagttaatgaaggaaattaaaagtactaccctgcgagcacacaaatgataagaaagtaaaacagccttattcctgatatggagaaagtttgagtgctctgaatagaagatcaaactagccacaacatttctttaagccaaagcctaatccagagcaaaaccttaactcccttcaattctatgaaggctaaaagagatgaggaagctgcagaagaaaagttggaagctagtagaggttgcttcaagaagcttaaggaaacaagccatatccataacattaaggtgcaagatgaagcagcaagcattgatgcagaagctgcagccaagttttccagatgaagctaaggtcatggatgaaggtggctacaacgaacaacagattttcaacatagatgaaacagccttctatttaaaggtgatactatctaggactttcatagctctagaggagaaatcaatgactgccttcaaagcttcaatggacaggctgtatctcttagtagggcctaatgcagctggtgactaagttgaagccaatgctcatctaccattctgaaatcacagggcccttaagaattatgtgaaatcaggccgggcacagtggctcatgcctgtaatcccagcactttgggaggctgaggcgggcagatcacgaggtcaggagttggagaccagcctggccaacatggtgaaaccccgtctccactaaaaatacaaaaattaaccaggtgtggtggcagacgcctgtaatcccagctactcaggaggctgaggcaggagaattgcttgaacccgggaggtggaggttgcagtgagccaagatcgtaccactgcactccagcctgggtgacagagcaagactccgtcttggaaggaaaaaaaaaaaaggaattatgtgaaatctactttgcctgtgctgtataaatggaaaaacaaagcttggatgacagcgtatctgtttacggcatggtttactgaatatttcaagctcactgtaagacctagtgttcaaaataggtttcctttcaaaatataactgctcactgacaatgcaccttgtcacccaaaagcttggatggagatgtacaaagagattcacgttttcatgcccgcttacacaacatccattctgtagcccaaggattaagaaaaaattgtgactttcaactcttattagttgagaaatattttgtaaggctatagcttgacatagacagtgattcctctgatggatctgggcaaagtaaatggaaaatctctggaagtcaggtgtggtggctcacggctgtaatcccagcactttgggaggccgaggcaggtggatcatgaggtcaggagtttgagaccagcctggccaaaatggtgaaaccccgtctctactaaaaatacaaaaattagccgggcgtagtggcacacgcctgtagtcccagctactcgggaagctgaggcagaagaatcacttgaacccaggaaggcagaggttgcagtgagcctagatcacgccactgcactccagcctggacaacatagcaagactgtgtctcaaaaaaaaaaaaaaaaaaaatctctggaagtgattcttgatgccattaagaacatttgtgattgataggaggtcgtcaaaatatcaacattaccaggagtttggaagacgttgattccaaccctcatggatgactgtcaggggttcaagacttcagtggaggatgtaactgcagatgtagtggaaacaggaagaaaattgaaatcacaagtggggcgtgaagatatggctgaattgctgcaatttcatgatcaaactttaatggatagggagttgctacttatggatgagcaaagtaagtggtttcatgagatagtatcacattctacagagaaatctttcacaaaaggaagagtcaactgagtggcagtcttcattgttgtcttattttaagaaattgccacagccaccccaaccttcagcaaccaccatgctgtgcagccatcaacatcgaggcaagaccctccaccagcaaaaggatcattactggctgaaggctcaggtgatcgttagcttttttaacaataaagtattttaaattaaggtatgtacattgttttttaagacataatgctgttgcacacttactagactacattatagagtaaacataacttatatgtactagaaaaccaaaacacttgtgtgacttactttattgtgatatttgctttactgaagtgttctggaactgaacctgcaaaatctccaaggtatgtctgtatttagtcttgagagtcatgagcataaacacctgtaaacgtcgcaagtactttcatcaaatgcatggaagcttatccttagtgtttggacttctctgcagataatttgttttaattgctacctcctctcctttaagatcagtttcctttgaacccaggatgtccttctggtatcttatctatgtcacctcaaactcctatgaaagctttttagtttttttatgtttcttgttcccgaaatatctgcatagagggttggttgccttactgtccatgggatctcctgtacttcaatcatttgcttgttggtttttgatactttctctgccttttctctgctctgctgtttattacagtacattttcctgctcccttaccaattggcttccaagtaagtttggccaataggagtcactggcagaagcctagagggcaggcggaaaggagaagccgggcgtacttcctttttcattctacctccggcaataggtctggctaactgtgtctccttcctggctccagctccctcggagcccctccctcattggtcccagctggccaaaggttccaactccgccttgatgcccatgacatctggggctctggtgataccacctcttgtcattgtccctccagccctaggtataacagaaacttcatgctgtgtgtgtggcttctcagcacttccattcttgagtaaccaatttcccgcattaaattccctttgtttgaaataactagagggtttatgttttctgaccaggcagaccctgattgatacatcttccaaatcaaaaaccttagtataaaaaaccttcaacataccatataaggcttttcacagttttagccctcctcatctctacagccattctgtgatacctccactaccacagactagtaccaccatcatttattagatatttatgctcttttttgagacagagtctcactctgttgcccaggctgaagtgcagtggtgcgatcttggctcactgcaacccgtgcctcccaggttcaagcaattctcctgcctcagcttcccgagtatctggtactacaggcagacgccaccacttctggcttttttaaatttttattttagtagagatggggtttcaccgtgttgcccaggctggtctcgaactcctgacctcaggtgatccacctgcctcggcctcccaaagtgtagtcttttttatcctgaatgatatattattttagaattgggggagggcaaacaacacagtacaaaatgtattattttaatttgcatgtcaaattaaagtacgtgtatgctttccaaaagttaggataaattgtgatcaggtgatctttatcaccttggttaagaagtaaaatacttcagaaaaatttagtggctccttgagtgtcaaatgtgaagacctaaacctaggtgtctctcactatctgaattcttggtatctcaattcaggaacccaatagattattaaataaggagagacactggtatatgataataataactaataataataatgcatatcactaatagcaattataattccttgagcagttactacatcagacattctgttaccttacatatgtcattctaatcctcacaacacaagataagtctcatcataactatttaatacatcacataactgaggtttaaaattattagtggcttcctttttgaccacagagaactggtgacagaatcagaatttaaatccagcctcaaagtcaatgaacaattttgttgctgcaaaacattgcctccaaacctaaactcataaagtgacaataggaaagtcacagtataatcaattagttcccccactgaatgcaccccataaagagtgcatatatcacagtttatattctagataaaagcaaacctgtattttaaacttatcacattatatacattatatttaattatagggggtgcgagagacattaaactaggcagcagtggctctgccgcttaatctctggttccttcctgtaacacaatgatttctatgctttgtcttctaaaacaattgctaaggagagctaccaagtgggaaagaaaatagatccctcctctgcctgaacttgactcaactggcaaaacattaaaccgcataaataacattttcaggtgttcctgtttggttaattatcctcccccgacctgagtcacttgatttgagtttacatttatactttcaaaaattaagtgctctagaacagtgctactcaaaatatggtctttcacaagcatagatatggacagtgtgttaagtaacttctatagcaatttgacattgccatgacatccaaattcatgatcaatgaattcatctcatggagcagggtacagacgaggtcaagtgttgttgaacttgactgttgagttacatgtggtgtgaatgcatacttgtcagtttcattagcaccacctaaaaatctgtgatgtgtagtatgttaaaaaccaccaccgcggctgggtgcagtggttcacgcctgtaatcccagcagtttgggaggcggaggctggcagatcatgaggtcaagagatcgagaccatcctagccaacatggtgaaaccccgtctctactaaaaatgcaaaaattagctgggtgtggtggtgcacacctgtaatcccagctactcgggaggctgaggcaggaaaatcgcttgaacccgggaggcagagtttgcagtgagctaaaatcgcaccactgcactccagcctggcaacagagcaagactctgtctcaaaaaaacaaaaaaaaaaacccaccaccaacaaaaacctggcccttcaccagtttgagaagcactgctcttcagtgatagcttctttttttttttttctaagacaacgtcttgctatattgcccaggctggactcaaattcctgggctcaagggatccttctgcctcagcctctggaagcgctgggactacaggtgcgtgccaccatgcctggccttaaagtgatagcctctttacagaccaagaaagtaaaatataaaaacaatcactttcttaccaaaattaatgcttggtaaagaaatctgtatgtaaatatatcaatataagcaacatttgtctccgttatataagcttctatttatgagggggtgtaatgactttcctggagttatgcaagcgatgaacgctttgtggaatagcaaattttgaaacattcccacagaatatcaccaattcataaataagctaatgattcatccactatgtcataagagagactttcagaatatttttaggtcattttattactaccgtagagggtacagactttaaaaactatctattttatgtgagtgctctgactgttctgaatctctttccagcaaaattgcagctcccaagagacatacagaggtaatcagacttgtgggcttaaaaaagaaatattggaaatgtctgaataagagcagacacgtttttagatgcctttactctgtgtgcaaaaatcatcttctgcagatccagctacataaaattgtacatatccagcacttttcttctagctgcaggtgtaaccttaatgttcctcttatttagatcagtaaactacaatttggcagctcttttaaaactgtaaaccagtcaaagtctaaggaacaattctttttgagtttccttctgaaataagcttggagagatgcaattcagaaatatctattatgttcttcaattagaagctttaaatcaagttatttgaacaagaaaaaatattataatatttagaacagtccattaaaatgccataaattttgatttggaagttacatttctattttacaaatggggaaagtcaatggatcctaatcaaagttaaaagagcagattatttttcttttttcttttataagctgaatagtaaaggaagaacatttataacagccttaataacaaatttgagtaaatctcctgtgctaattttgtcagctagggaataaagaatgtcatatggattccagtttaattatgccgataaagcagttttataaatcatgctaagagtaatggatgttcctttgagaacagagaactcggagtttgtaaaatgtgtgttctggacttggttccttatcttctaccatagtgagtataaatcaaatcaagtcttgagtctcagtctgctcaagtccaaatggaaagaagggaaaagttgccccatccaccggtatggtagcattatttcccaaatcaaaaactggaaggacactcaaagggatgacaggacaaaaaatctgaaactgaaattgatagaaaatccaggtcatatgccacctactctatagctgtgtgaggattaaatatggttatttctgaaaactcttcgccattgtaaagtgctacacaaataaagtacaattattacaaatatgattataggctaggagcggtggctcacgcctgtaatctcagcactctgggaggccgaggcgggtggatcatgaggtcaagagatcgagaccatcctggccaacatggtgaaaccccgtctctactaaaaatacaaaaattagctgagcatggtggcgggaggctgctgaggcaggagaatcgcttgaacgcgggcggtggaggttgcagtgagatgagatcgtgcaactgcactccagcctggcgacagagtgagactccgtctcaaaaaaaaaaaattaaattaataaatatgattatcctattattcatatcctttaggttggtggtgacaaagaggaactgggggtttagggctgacaacattcatacaaccaagctttactctagccaggggttaaaacaaaaccagtcatttaatgatgaaagatcactggccaacatgacatataagaaaatgaagaccaatagaaagcaagggacttgcccgaggtcacaccaaagctggcatctgaatctagctatcctttccagttcaaagcgttatggcagtaaaaagtcaaaaggcagaggttttaacactgagcaatatattaaggaactagaagcaagagccaaggaaagctaaatattgagtagcttagtggagaacagtttagttcacaaaatatgctgagaaaagcattaggacaagctcctaatgcaaaaggaaggaattcatagtcattcagaatcctgcagtttctaacccaagagcatcctcaggagggaatacttaatggaatgtagaaagcctatcaaaagaggagagtgaacaaataactacaatatcccttcctcttgggcaagctgaggaaagaggtacaaggattttgatagcagtgtttttaactctcttgcaaattgctgatttataatgatattgatgtatctttaaaaagcttttagccccattgacttaactaggacttaactagttctcctaactagaactgctgaagaatcacacccctaacctcaggcccagcagaccctaaaattaaaccctcattttaacattctgaagctctctgcaaaccatagacatgaagctaagggctacgtgctgatagactgccttcaaatcttatggtttttaaagaccacttttcctaagaattccaaaaacactcagaagtccatttttgaaaattgagagctttcgcatcattcaggtgagcatcatgctggatagtaggatccaaaaattgggcaacagattaaaaagggctagatccttctgaagaacgctataacttaagaaaaggaaaaccagtaccccttgagaaaacacttgtggttaagagggcttcaatgaaggaaaaggaaattggaataagtaacaccagaacatacggtgcatctagattttaataaactgcttgaaataaaatcagctttctgaagtgcagcgattctctcttcacattatcctatttttacctacatgtctccttcataaactggtcttcttgtactatactgacagtatcacaaatgcaaaaaaactcacattgtaatttaaaaaggaaccattggggaaccacatattttattgtatttataattaagagacccccccccaataagacaggctaagaaataatgtttttaaacagggtctcgttctgttgcccaggctggagtgcagtgatgtaacctcggctcactgcagtctcgtcctcccgggctcaagcgaccctcccacctcagcctcctgagtatctgggactacaggcacatgccaccatgctcggctaatttttgtattttttgtagagatggggagacggggtttcaccacgttgcccaggctggtcttgaactcctgagctcaagtgagctgctcgcctcggcctccaaaagtgctaggattacaaatgtgagccactgtgcccagcctaaattctactctgttggtcagtatatctgtccatatgtaaatactcttgattacttaaatttgtagtaagatttgacattggaaattgtgaaggccaggtgcagtggctcacccttgggatctcagagctgtgggaggccaaggtgggaggatcgcttgagcccaagagtttgagaccaggctgggcaacatggtaagacctccatctctacaaaaaatttaaaaaaagattagccagacacggtggcacacggctatagtcccagctacttggaaggctgaggtgggagggtcacttgagcctgggtgttcaaagctgcagtgagccatgatcaggccactgcactccagtctatgtgacagagcaagatgctgtcaaaaaaaaaaaaaaaaaccccaataaaagtatctctaagcagcatatattatgtgtgtgggggcagggtgagctttttaaaaaatattttcttaaaatttcagtaatgaacttagggacctagacataaattgtgagaaaaggacaggcttttaaccacataattgcacttcatgtaaatcaatattatattagtatttcaaaataaattccagagcatattactatctaacatctactgatgttgtaaatgctttctggagccttgaagagctcagagttttaaatcaccaagctaacctattggaacagtctttccattacatttgtaaaaatgctaatagaaatctaaaactcacctcatgaatcaaacatattattacttctagggagtgacgaagaatgtaccctctcaataacaaatgaatgacccagaggagtctaatgggaaatatctcaagagcctctctatttgacaacagcttgcctcactcagcctgtaagacacggatgggtggcataatcttctcctgttgtttgttttctcagaatgtacattttaaaacataggaatgattacatttttagaaatccacttgtctgcagagttagccgaaaggtacctcttgaaaaataatgatcacagcaagtttagaaacagcctgccccaccctcagcccaaagtaaaagaaaaacaaaaatcttagacacttgtccaatatcgttactttttttttttttttttttttttgagatggagtttcactcttgttgcccaggagggagtgctacagcgtgatctcagctcattgcaacctccgactcctgggttcaagtgattcttcagcctcggcctcttgagtagctgggattacaggcatgtgccaccacacctggctaattttttgtttttttagtaaagatggggtttcaccatgttagccaggaaggtcttgatctcctgactcaggtgatccgcccacctcgacctcccaaagtgctgggattacaggcgtgagccaccgtgcccagccccaatatcctcacattttaaagataaagcaccaaggtctacaaaaaatagacatgagacacttggtctcttatatcccacttactccactactattctctactaccattctatgactattgggggtagtcacagacaaatgctgaaagaaaactgatttccagttgcttttagtgatttattccctgtgaaaatccaagacaatgcttttgtcaaaccattaatgtgatgtaaaaaattttctggggactcaaattcctaatgactgttcagtcatcatagtgaacctttaaattatttctttactatgtcttgctttgtttgtgtaggactctggcaatattttctctcaattttttgtgtaggtacacagccgataaatgagggaaacacaatatttctaacacttgatggaaacctcctctgcaaagccattttagatctgttggaaataatctaaaattaattatcttatattgttttttatctattttttaatcaaaaaagttctattttctctaccactaaaatgtctacatctgcatttttcacaactggacatacagactaaaaatacatgagatgatctctttgagtttaaagttacctgacaaagtccatgagaatcagggtccttaagtataaattatctacatatatgtggggcgtgtgtgtgtgtgtgtgtgtgtgtgtgtgtggctactgctgcttttctgtcataagttctcattagttaatgaattgtagctatagagacactaagtaagaaatggaatgggggtatcgacgaagaaacttttttaccaaacatctaactgtaaataatataaattcattgtagaaaatcagtggaaaaggaatgaaaaagaaaaccacccagaatgtattagagagctccaatggtaatatctcaagcaatattatagcttttcatcagtaaatacttgctactttttcagttctaacaaaatgttttcaccttctaatcctattgtgttcaaaccctgggtgcaggggaacacctgaatgcttttgagggcaaggcaggtaacataaacatgtgttgaacaggctgcttgggaactttggcaaattagagaatggaaatctccttagaagtgggcgtctctaggaatgtgtaacctaccatgcatactgtgaaccactgtagcttccacggtagagtatgcctggagtgggggtacagagggaaaaagcaacatcttgatattttcagcacctcaccagagacatgaggttcaggttcgattaggagagggggctagatgtggtcttaaacatttgacacgccagaccacaacaccatttctgctttcaagatacctttcaccaactgactgtagttgaaggcttccgaccatttcatccagctcaaagagcaatttggacctaaagggatacctcttgaagaagaaaaatataaactaataagtaaaaactaaaatcaatgaaaagtttcttttcagtattttatgcttatgtttcgactctgaaacactgtaattttggagagggggaaaggcagtgctggtagttaatcttatatgggatctcaaggatgtaggcaggctgggcgctgtggcttacgcttgtaatcctaacaatttgggaggccaaggtgggaggatcacctgaggtcaggagttcgagaccagcctagccaacatggcaaaaccccgtccctagtaaaaatacaaaaattagctgggtatggtggcgggtgcctagtaatcccagctactcgggaggctgaagcaggagaatcacttcatcctggggaggcggaggttgccgtgagccaagatcgtgccactgcattccagcctgggtgacagagtgagaatctgtctcaaaaaacaaacaaacaaaaaaggatgtagccatataacaatcattctatatgtgccaggcaacagtgaaaggagtgcccattgtttaggacccaccataccatttccagaaataccactcaagtaacttactattcataggtaaaactatcaattcctatatacgtgtagcaggtatgtagtaaccaacataaatatactttacctagtaaataaaatcaatgagaacagtgaaagtactaacagaaaactgaggacaaatccaggtgtagccccacatagctgtgtagccctgatcaattcctccctgagcctggcttcgctgtcctgtgaaatgtggatgttgataccatccaccatgcaggttggttgctggcacatcccatgtggaaaacatacaataggcccgcaataaatgggagatgttatctgatgaatcaccacttggataaaagcccaacgaatgtttgattgttacaaaactattggaaatattaactctgaaaggtgaaaagcaaacttcaacacttagttcacttgcaagtggtttgttattgggctagcaagaaacagaatttcaaagggggctggaattgatcacacacttacgatgacttccttttattatataaaaattatacctgaaagttgatttcataaaagagaaagtttgcaataaatgagttctaaaatcccctgcaactgtaaaattctgttataattcaaaattgagtgatgtcacaagcccaatgtcacaagtcatgagagattatcagttttgagtttatcaccacatctaaagtatggagaaaattttagaaatataatgattaaatgtatatttaatttgtattaaaggagcaaacatgtattcattgatagtccataattagcttttcatcaaacatgtttgcaatttctcattacagagtaattgaaagtggtagagaatactatacaacaaaatggaaatatggccatggtaatacattactttccagtggaaaaaaaaaaagcaagttataagacagaatgattcaacttctataaaaatatatgtatagaaagacatttttgaagatcctagactattaaacaccagctaactctaagaagtggggttacgaatgatttgtctcttctttattgttagcctgtctatatttttaaacttcaaaaatatgaataggtattaattctataataataatgattttaaaataagagtgaattaaaatattacaactagaaattactgtaattagagtaggaaatgttagaagtgggctaaatctgtgtaaaccacaggttacgatcaggaggcccacagactaatttaaattagctctttgtggacagatttctagtttttctcttgtacaatcaggggtcctgggagtactgggatagaaagaccagcttgcccaggacagctgctgcccacttcagatgaagccttttcattctctcatttgccaaaagataagcattcacgttttccacctgtggtataaacagtccacaattataagccaaaaacattctgtaggggctggaaatgtagcacttgaaaattagctgatcccaattttatttaaaattttaaacgtttacacacttataaccagactgaaatgacataatattactcgaaatgtattggatctctctggctagtataagtgactttgtttttcctttttcatgttttttatttacatttttcaggttttctagaagacatttaatcatttataattagaaaaatgtttaataaaaccattttttggctaatatctcttctctagtccttggtgtctctatagctgcaattcattttgtgagaatctatgacacaaaagcagtaatagctacgtaccccctgacacacacacaccccacttacgtatacctacacagaatttatgtttaagtaccctgattcccacagtgttcatcacataaccttaaatccaaagagatcgccttatgtgtttttctatcaatatgtccattcacagaaatgcaggcttgaaaaagtagaaaagacatgacgtttttatattaaaaaaatacataaaaacacagcctgggcaacatagtgagacccatctctacaaaaataaataaaaataaattttaaaaatgagctgggtgtggtggtgcattcctgttgtcccagctactcaggaggctgaggcagaagaaccgccatgagcccaggggttcgaggctgcaataagctataaccgcaccactgcactccagcctgggagacagagcaagaccctgtcccaaaacaaaacccaaaacaagctgcaacttaagataactcatttcagaatattccttgtagatctaaaacgacaaaccagacatctggacatttgtccagtgtaaaaagactggtgttttcaaacccttatttgtatgctctgtacccattcaaaataattcaagttatgaggggaaagaaaacagaactgtcaggctcttacataaacacaaaacaagccatactaaagaaatcatttaaatgttcacattaatgacccgccaggccttaggaattgtgagcaccggaaagacggcagaaaattcctttacacaacatttgtggtttggcaaaagggttgtcttggtttcacacggaagaaatcaacaagcacctgaaacagttttctatcttcgtgggaagaaaaaaaaaaatagccataaattgcaactgtttttccatcattttaggcaccaaagagaactacaaagacctataggccctctcaggtatattgaatttttaggaatcaatcaacttctaaaacttgtttttaaggaacctctgataaaaagaaagctgactgtcaattttggataggaaggtgccactgctttcacccttgaaacaatctagtgatgtatttatatagcaagtaactttcacactgcaaactactttatcctaaaggtcacctgtcatttaacttggaggaaacatggccatgtccttacctaaagactggtagagctctgtcattttgggatggtcccagcaagttgtttgagtctcgtggctaaaacacaaaacataaagaaagactttagcatttacaatgagtagtcaagaaaacaggaaaaaagaaaacaacaataacaacaacatgatttttgcttttgaaccattcggaatctttatttcaaagcgcttccatagtgtattgaagaaatgtttatcttacaagcagaaaggcccctttctgctttgtttccaaagagaaaagcaatataaacattattcggttccagaatttgtttcttctttgcacccacaaatcgatcgcacttcagttatgataaattgaccttgttatgtgatcaataatcgactatcaggacttcttcacccatccaatgtggaacactacagaaaggacaccgacaactgattattattcaactctgtcaaagagataccggacattagttcaataaatataaatcatctcacttctcatttgctttcactgcccctgacatttttccattactctttcctctacatatacagatctcatatccatgatacctgtatttcatttcagcttaaggtatatctactgcctgactaatatatcataacttccttcttcccattatttcagagtgttttttctttaaacgcagtacgctatacaccactacacctcttcctatatttacttgggcctgaatgaagcattcacagctgtcttccatttcttgaagtgtggttgctggctatcagctcctgccacaaaaagaacaaaacacctttgttcctcattcaattacatgaataaaccctggagaaataactacatatacttttccttactttggcccatctacataaatcaccatagcgtcatatttccagttttcagggattgcatgacaggctttgatacagtaaaatgcagttctgaatgatatttgggtactcatatgcagagcctattcataaacttttgaggggaaggggagggaaggaaaaaagagaaatcgcttaaactggggcatttccagaggaccagaaagtacaggggcctcacacagaaagaggagtctggagaggcaacaatgtcgaatggccttagcgtatgttttgaattttagggctctgcgccctactggcggtgaaatttaaagcaagcctgcctaccttggagggttaaaggattagttgaaataggtaagtgaccggcaccatttggtgctcaatatgtggtcgcttttggtatcatgtgcccctcaaattgtcatctattaaaagcaaatctgttattagttgattacaatatagatgtggatccaactgtaattaagtcaatcaaggcgaagaaagacccttcctagagagcaaaaccaacacactacatgttatcacctatgtttaaaaaaaataagttaaaacaaccgtttaagttggtttaagaaatggaacacaatcataaacctcataaagacatatggaaatcatccaaactgtacaacttcaaagaccatccctgtaatatttactagtcagtgattgaacagtgagggctactgaaatcaatttgcaagaaaatgttcacttgtgaagtgctgtttcactgtcttccaaatacgtttatttcagttttacttttccatagagacaactcacatttgaggactataacaagggcttatcagttgagggaatataacagagtgacattcaagtcttaaagagcaagaagagcaggagatatggtctctatgctttaaggggttttaggacaccccatgaccaagccggtttatgatctggagaaggggtaggcaggactggtactttacatgcacagcacaaggaggctgcagcttgcagcttcgtggaaaaagtgttgcttgttctcaggcatttctcagctcggaaagtgagtgtataccaattccatatataagtgcagagcaaggaaaggttaccttctattgagaccaccctgcattcaggcctcctctatttccaaaggtcatccagatgtgatataagcaccagggagaaaggaagagcgaagagaggaagcacacacatgtgtgcccacatgtacaagggctcacacaggcccttactagtcacactgtgtaacaacaatgtcccatctccaggatatttgtaaggaccgtagcatcttctataggtctgcagaaaaacatttagctgagctgataagcctgatcagacagagacagggaaccacggtgaaaagccaccatctggaatggacttcaaattagaggaacataggcaagaaataaacctgtaccaaacacagttctaaaaggaaagggaaacagtgtgtacaatttacaggagaatcccacatagaatgaatgagggcttcatggagctccccatcttctaaagaaatttcatgactgttggcatacatacattcctgcctttttaaagaatttattttgaaggttaaaattatgaaaagggttttagaaattatttttttttaatccatcagtcctcggcaaaactgaaaatctcctttactggaagaaggaggaaattctaagcccccaattccattgcccatttgtgagttaagatactagtccttgataggtactattctcccagttatctgtgattctgggggacttgaataacatagataaatgaactcctcaaacaattccagaagctaacctttctcaccttcaacacacaaaccttttatttctaagcaatgcaaaagaactagaaaaacagatttagatttcacctttgcagtcttagtttcacttcaattgcaaatcagttctaagcaaaagaagtgagcacaagtggaaagaagaaaagaataaagggtgtgactaattcttaaaacgagaaaaatagtcttttaatcatttaatgctaaaaatgcttggcaacgtagccaaaaaaccttcagattctttggtaactatatgacgaaccaaatattcacttcacggcttgttattttctacctgtgatgaatccagagccccactgggacacatttaaccctccaaaatagataggaactatgaatatggactggatgaaactgtaagcacaaatctgcataactcatatctatcttgtaccttgaaggacaaaccacatttttgtctgtgatcaataccgattttacagcttcgtttcttactctgtgcctgccttctaaaacagtagagaattctcagtaactccatgagaagagcccacatttacctggaatatgcagacgatatagaaaaacacggtgtgctagggaggagggagtggaagggtgggtggcactgttttggtaattgtctcttttctgcatttcactctccacatcggaaatacactccccatataccatgaacaaccaaaagggaaattctgaaacctgttcacatgttaatgggtacatctttgtttggcctttctgagaacaacaatgttcaacatagatcacaagtctgtacgtacattaacacagagatcagcttcataaataatccttaaaacgctctttacatctttaaaaaatgttattgattttggccctgctggttccaaagcctggcatcagatatgcctctctgagcagtatttatacgaagatttcccctctccttcttctttctacaaaccatgataatctttttcccttttatttgaggcggtgataggaccctgatgcaaattaaaatataaagtcatcgactatgacaaaagaccccagcaacacctacttgtcaataataagaaattaaagcattactctactgagcacaaggctgacctaatttcctaccatacaatttaaattttctctcacctgctttagtttcaagtagtgtgcaaggttattataactgcctcagagctgttcctgctgtcagtgctggaataatcagacttattggaattgcttttttagtttcttaaaaacaaacattaaacacttataaaaagtaacaaatatctactgctgtggctgggaaaatggcagttgcctaattaaaataagatttcttctgccaccattgttatttggtactgaaaatattccaaacagttgcctttttaaaaaactatctgtccactacttcccagggagaaaactaatcgctatgcagcaatataaaaagggagcgttctcttgcgatttgcagaggattagagtttggtttcatatataatctggagcccattgatccacacacacaaatgatttccctttaatctgaggatcagactctttttctagaggaaccttggcatttgcgtgctgaattgttgaacttggcttgcattgctggaatactggcagggtgtggatggtaaaatatattttaaagtttctgctaccgtggggcaggggtttggaggggtgggcatcaatataagcatcagaaatccattctagttccccatttcttgttccctgggatatttaccattttattctgtctggctaaagccagggcaaagatgattgcctcggtggctgttccagctgttagttgtcctccgttttatttgcttttcaaggtttaactcctacccaccctcaactttggtcaaagcaatttcttttcagggtcgtgtccaatcggagatcaaacaatgatgactgaaaccaattccacggtgttcaagggtcagagacctttcatataaccgtgttgcttcatttgctccactcgcttctccaacagcaaatgtatcctccaaagaggggcttgagtaaaaggcaataaaaaagctaggcaaaaaaagaaaggttgattgggggtgtggggggggggggggtgggtgacaaggagagatgacagggataaagcagaagaccaagaagagtttattgcccaaggaaaaatgtagatttcacttaaagacgccacttaaaagttcaccacttaaatcggatggatttttttcatgatgtaaaaacagtttataattaatattatgcctccctcgagcaactaaaccccttcaatttaaagcttcaaacttaacttcaaatttgactaatataagcaaagtgttctgccctttttattgccgtgctgggattgggagtgacaaactttgcttgaagatgagcacagacacctggagaaatgcgagagaacaccctagaaatgactccacacccaatcccgaagggcaaaaaaaaaaaaaaaaaaaaaaaagcccaaacaaacaaaaatccccaccccctgaaatctttgacttctgggctttagttgtttgttctttctttcctgatttctgcaggtcttggggcatggaatgagcacggtagaaaatgcagcgagggaaatgtcagttggaatcctcggaagaaatcaggcagaaagttgaccttttggcacttgcagtgcaatggaaggtagcgccgcgtgcgccccttccttctacgagtaagagcgacgatttaggaacagccagccttgctcacgtccacactggcagcctggaaaggagtgaaaagctcccccggccccaatccccgcgtgaggaacgcgttatcccctctggggacggggagaaatcagctttttctctccgagcccgtcccaaagccgagggaagaggttcccccactagcccggcgcctggggagaaaccccgggggcgcacctgcagccgcgccgcgggaacccgcgggagaggttcctagacgcccagccgcccggcgccccgggtccagccgccgcgcctgtccaagttttgaccgcctcagcttgccccctgctcgcgccacaagtgcacggattgcggccatcagacggggccggggccgcgatccacttaccctttgagctgttccctcatggctgcaagggctccgcggtcgagtgtgggtacgagtggaggagtgagcttcccagagccgccgggctccccgaaagtggagcgccgccgccgccgccgcccaagctcacagctgaaagcactgcggaggagccggcgcgggcgggccggggagggggcgctgcgggcagacggggcggggccgtgtcgggctccgcccccacctagggacctgggaacccggacacccagagactgggcagttggggctttcaaaacggaaaggaaaaagaaaagagaaagaaagaaagaaagaaagaaagaaagaggatggggatttaaggtagacccaggaacctggaagccacacaccgctctgctaacacctccttaaagcctctagcaagactacttgttgtctaaataaatgacccaggtgcaaatgacctcatcccagataattaagagtgtgggcttggagttttctttttaaaaaataaaagaaaaaaattatatacataattctcactctcccttcctcctcagttgaagattaaagtggccggcgataaggacgtgaaattgccgttaggctcatcctgggctaaaagggattgttaaaaagactttggatttggatttgtgacatagcagcggatctcaaaatgtagaccctgggaacagcagttatcagtatcacctgcgaacttcttagaaatgaaaattccctgggcccggcccagacctattgaaccagaaactctgagcatactaatgtttgagaatcactggtatggactctctaaattaagacaataccaccagtgctgttgcacggtttggtcctttagtattcttttaggaagatctagaaggaacttgtttctaatagaatattttattggaaaagttacagggcctgaacagttcaaataattctaattttagagtttgcagtatgatgatagaagttaactacacacaattatttcaagcttggaaatactcaaaagaagaagaaagccttcattagcacaagaattttctgcaaacttcacataacaccttagattagcatccaaagagcatcttacgataaactgttagtgatattttcactgcccttctttgtccatttattttgttggcttgcttttctttttattttctttcaaacatttgctttccactctcctttccgattgattcattccacttcggtctacagtttaaatgtggtcccctttttaaaatttatttcttaagggatgggggtctcactgtgttgcccaggctggtctcccaactcctgggctcaagcaatcctcccacttcagcctccaagtgcctgcgatgacaggtgcatgccaccatatccggcttcttttgaaataatccttttctgctcaacatttttccccctagaatgttttaggtggaagcacacccgttttgctttatctaatgctatagcatggcaaaagaggcaaaaataaagtatctggacaaaagcaaaagggaatgccaggattctttattacctttaacaaaccaaatataaaggtaaatgttatcactaaagatatgtgcatgtaagtatgatcggtattgctatttttaagcaaatatggcacttcttctggcattctggctcatacactgagattacttagtgttgccctttagcaattttaagctagtgagttgtggaggcagctgctattacggtctgaggggggcacactaagatttgctttggctgaagttgtcccttggtctaatagtatattctaggtctgctccgatccttggggaagagggattagtgtcctgtaatgaggaagtagtgccctttgcagtaaatcagagacaccaatctctgtgtcagtgtggcaaatcacttaactactgtttatgtttatttcaacgaaaagacagaagcctcagagcatggacatttgtaaatattacaaatcgataaactaaggatttgtaacacctggatagtaagacatttgtcactctcttcctttcctgttttttgtttgtttgttttacacttttaaattacctgctcaaaattcaggagttctgacacgcttctctataaatgcttaagtctcttttctcagtgtccaattagaaaactactaagaataatctgttgacaagaaaaaagaatggaataagaaatcactattcagactttttaaaaaaattgacagatggcaatcctcaaaaatacatctttaagttcttttttagactggagttataggcacttgaagacttgttcccaaatcttgacgtcatattataattaaatactgaaagtattaagaaatgacgcgggcatcacagagactgttttgttgttcaattgcagtcagattatgaattttgcttattagaggaaagcatttggaaaagaacataattgatataccttcgtgtcatatgtaaattatgtagtgatgccatgtatgataatatattgtttgtttatagtagatgtttcttcttctcctccttctgattatattattattattattattactgttttgatatgaaccacggacatgaaaagagcctgaagctctgctaccagaacaaacttcagctaaaattttgacttcagaatcagccatgacctacttgttcccagtaccactgtctagaatggtgcaaggattggaattggggaatccagctcgaagactcatgcgcttagctattctgctatgctgccatgaagagacatggcttcttttcctgtgagaaaggtctgtgttttttctagtatactcatagacaatctcactgatggctcagagcagagaagagtaaatttgctagaaatagagataaagaagaaatgaaatgggatgaggtcaaagaaggcgacccagtacattttcccgtagccaaaactctggtctttgaaccacttaaactttgagggtatctttagagaataagggcatctctgacctaagggactgtgcaggatgcttccccattctcccatccatctctattctttgtccttctccattctgctctgtggcccaggaggttggacctctgtggggacatcaatcaggctttcctgccgtttggcttccttttgctttcagccaattgggaggcagtgatgaaaggcctacagaaggagaggaaaggacaggaggaaggtgatgtttgggtatttattcttcaggttccctcctactgatctctggcctggcagctgctgagttccttgacctgcagccacaagtcttgttggccagtcctttcctacagcaatagcattccaccagttacgcaaaccattcctccctttatccctttgggcaaaagtttaccattccttgtttttttttttttctcctagcctgcctagagccttgtaaatagccttttcattatactctcttcaagtgttccgtttgaatgtaccatctgtttctcccaggaccctgaccaaactgagacccatccagccaaagccaccctctggggcaatagacttgatgctgagtggggactactgatagaggagaaagtcagatccccccactctggggctaaaaagcagatgagactcagtcattggataaatattcagagaagcctcctctgtaggcccacaaagagcttctggccttttgagggtaaaggcatatcaacaattatgatggtgacaacagcagatgtgagggtaaaaaggatgcaaccagcttgttctttacaagagcttcaacggtctgcttgatcttttggagagaatgtcaagataagggttagagaaatgggcaaactggaaagggcttagtgtgacaatctggagtttgacttgtatcctgaaaggtatgagggagctttttaaggaagaaagaattaaagcatgagtgtggctctgtccggtttgtcttttagaaaaatcactcaggcaatggtatgggggcttgatcagaagacaagagtctgaaattcagacatcaggtacaaggagattgcagtatgaggaggatctgaattacagcagtggcagaggaggtggagaaatgatacaataaggttccaactacaggagtcttgactgactggatgtatgaatggaagagagggaagaagtaaagcaatagtcctcaagcttggccgccctttggaatcactcagggattgttaataaatttagatgtttgggtctcaccaccctgagattctaatttaattggtcttggacattaggatttctaagactctccaagtgattctaatatgcagtgaaggttaaggaccattgtccttgagtgacaacaaagattggatgagtagcattctccgagctaggaatttcaggaggagggggcagaagagggttaggaaagagatgatgaatccagtcttgaacataatgaattggaggtggtgatgtaaaagtgcaggtatccaagagacagttggacatctgagtcttgagctcagagggaagatgtctgaattggagctatggatttgcagtgtactgttggaagggtcttgggttcgaatgagcccatctagtggaggctgtgaagggccaacagctgaaactaggctgttcctaccttccacaaacacatctttttcctttctgggttgcatgtggtttcaatgttggcctgatgctagctgtgtaaaaatgcagagtggcataggaaaggacaaagacaaggaatggtttgaactgggtacttgcctggagggatggtcccgagagacttcaccaactcctagggttcagcttctctctatctatagtgcgccctaagttttagtataacctgcatcactttataaaaattcatttagagtataggtatcacttcaattaactcgaatacatattctatagtaaaatgtcagcatttgggtatacaataaagacataagaattccatattcctctttgcatagtacaagtactaaccatgaacagtgactcagacatctaacaaatgggttggtgtatggtgaatcattgctggttagggcaaatattatagcatactaattgaaatatatatataacaatccccctagatcaatctgaaaccaacatcttctggatgtaagaatatccagccaggtcacattaaccagcaaatgaagaggcctctaagttcagacacagagcacttcacacccacacaaaagcctatttttccaggccctgtctctttagggaggcagagtaagccagactcaggaaagttctctgtgagccagctgccatctaaaccagagatttcaccagacaggttccagataaagtcgagctctgcttcactctcacacagttttcttttaataagatttctcaaagcttcacagagccacctatatcaagccgaacatctaaaaagatgtgaattttagcatcttcactaaaataaagccatacttcattaacctcacaggccgacggttgcttcatgggaaagaatttggagtacctattagcctgccagctatagcgataacccatgtatatgacccacaccacctcctgctaaaaatggatcactggttaatgtggttcaagtatatctgactacagcattcctggtctaccttaacagctcaaacttgtaactatttgtctgcctttccccaccgattgtgccaaataagcggaatttcaaaactgggcagaaattcttacactctgcataatctctcttcctcttcagctacaaataaggctttgtattcgattagactcacagcaggtgaaaaccccaattagtgaattcattctgaggcctctaccttcctcccacacaacacatttttgtaaaaaaatcagggaagtctgcgtctcttctcaaatcagaagtaaattaaccctttgatctacccaagcaaactatttactgcatgaagacttttcactgcaaaatgggaggatgttgaaagattcctccttcttgactccataagggaggttacagaaaattctattttatcagactttattgttttcttcaaatccataaatactcacattttctgatcaatctagaaattacagtttttctttctacctgacactcacaatgctaatattatctaacaaaagattaatggacagtctactacaagagagaattaatttttagttatgttcttattttggtgtatttgaggtgagaaaaaaaattaaattttagtttaaacagtatgctttggccttaggaaaggcacagagtctatatttcatactttgtaaatatttatttgtcaaagaaaattcatcattggacaaggatagatgtttggttgaacattaaaaaaaatcaacgcagctttagttcttagagtgatttactcatactttgtcaattgcttctctggaaacaattcacaacctagttttatttatgaacatatgattaaaaaacagcagctttgtcttttttaattgttttagtcctgtcacttttcttgaaacaagtcgtaggacttacccacaagaaaatactgagcatatatcaagtagtaatgcagcttttagaagtagtcatctgttactgtcagaggttcatttcattttgagtctttttaattaaaatgcaaagttctacatacatgcctgcctaaattacccctttctgaaatactcaaatttcaaaaaaaaattttaaatgctaatgtaaccattgttaatactctagacttgcttcttgagatttggaaaaaagtaaacaaaggaattaccagtcaattaagcgaacaaggaagtcatcctaagttgaaacagataaggaaaatgtaataatcaaatgctacagatgaagacaccagcgtttttctttttttttttcctgagatgaatatctacaagaatcacgctttatcaaaagcagcttccttaatcttcagcaagcgtagctgtgtattatagcaaaggcatgaagatagaggggcagagtgtccagaccaattctaccccttagaggtgggtcacttaaccctttacaggcaagtcacttaaccacttggaagcttttgttaactcatctatagaatgtggataatactgccatattgtgggtcaaaatgacacaacggctctgacagcaatttgaaggctggggaatgctgtgttcatgcaaagcagcctgtcaggcaggtatgatttcttaaaagagaactcagtatgttcaggaatagttaggtatacagaaccaaataaattcactttaacattctgttttagattgtcgtgtgagggaaaatgagaggtctgagtttagtaaactgctcttctgtaaactgctctttagcagtttacaaaaggcacctttcctctttttgctttttacacttaagaaggaagcaagtaggaaaagtaagattttttttgtgtgtgtgcaagataaggcactagctgtagcctgagataggcataaaattcacagcgtttgctatcattcagtggggccgagattaaaatatgaatagtattcacgcatgttaaaaggtatatccatgttcatattctcagacagcagaaacctggagtagtcagagagcaagtgaatattgatttggtgggggacagtgagggagaaatatcccctagcttgatggagaaagtctcctggtggcaagccttgaacagccagcaagtggcaggaattccacacaaagacagggatccataaaaggggaaataagataaaatccagtttaaccaattaatgatctaccaatgtctgaatcttgtactccagctctggcttacttttgtcaaggcatgttttcaagatgaaaggaaaatacagatgcaaggaacttttatttatccacaaatttccaagaatgttttttatgtgctctatctagactaagtttctctattaaatattatcctatattaagttctttaaataacttcaaacatagtgtatttatggaacacttacatatgtatttgcttatcatttaaactcttctcattttttctttatggttggtaaaaactggggagtgtttggagaatgacatggaaatatataaaaatttcaacattgtaatccagtttttttttaagtgggatcccaaggaaatatggccttttccttaaggagcttatgatctaatgagagaagatagacccatatatagctaaacacagtatcagacagattataataattacagaaatagagagaaaaaaagcagcaaaaagggaaaggtgattagtttggcctcttgggattagagaatatgcacttcaattaaaaactaagtaggctttaatcacctagttagttcttaaatcaggttttgtgtgtgtgtgtgtgtgtgtgtgtgtgtgtgtgtgtgtgtgttctttttgctagaatatgaagagttgaaacaagtttcttacattgactctgtgagctaatcgctcatattaataatttactaaggtacagagtttttatgttaatatacagctgtgttacgacatcagtttaggctttttaggaattcaaaaatgtatttggccaatattggatttgatatcttgggaaggctaactggcagaaaatactactttccccattaggacatcaaagcacattattgagttaatatgaacaagaccttcacgtgggaattgaagtcctcacagcttgacctactctcatcccttagaaacaggtcgacaaagaattggaagcctctttgcatatgatggatagagaagaaaaaattggcaccacctgtacttttgaatatctttctttttaaaatagaattaaatttgaggtgggaagaaacaagggtggaaaagagggtagggatcagaatggaaatgtatgccaagtagatgatgacaacagcccagttaagagtggatgaaagtctgaactaagaaaggagcactgggaatttgtggagaggctgaattcatgacaggttatagaataaaatcaatgctacttttgagccaattgaatgtgagggctagaggaaaaggaaaagtgtaggatttttgataatggccctattagctgtgcattcatggattcatatttgtgtatatactatgtacatatttatactgtgcattgttctgtaaaggctttagggcaacttataacaatgtataactcttaaaaattaataaaacccagcactaaggaaatataaatagcataaaactttaagaagcgaggaaaatttagaacacagatttgttttttgttttttgttttgagacggagtctcactctgtcacccaggtcggagagcagtggcacgatctcggctcactgcaaactctgcctcccagcttcaagcaattctcgtgcctcagcctcccaagtagctgggattacaggtgcctgccaccacgcccggctaatttttttgtatttttggtagagacggggtttcaccatgttggccgggctggtgtcgaactcctgacctctagtgatcagcccaccttggcctcccaaagtgtagggattacaggtgtgagccaccatgcccagccagaacacagctttgaagatcacagtgcatgatgtggttatgaaaattttgctatgcatacccaccagaatgagcaagacaaacaacacagggttagaaaggatgtggagcaactacaactctcatgctctgttagtaggagtgcaaactggtacaaccacattggaaaactgtttggaagaatgtacagaagctgaacacacacagaccctataacccagaaattctaccccttgatatagtcctcaaaggaatgcatacatatattcatcaaatggcatgtcttagaatgtttataacatcatttttttctaccaaatgcccatccacagtagagtatataatatactgcaggatattgacacaatgggatattacatagcaattagaatgaacaatccaccacttcatacaacagcatggatgaatccaggtttaaagaagtcagacacaaaagagtacatgctgtgcaatttcatttatataaaggacaagaacaggccagaatatttaatggtgttcaaaatcaagattgtggttacccttggaggacaggtaactatcagaagggcacacaaagggccttctaaaggttggtaatgttctgtttctttatttggatgctggttaaatgagtgtgttcagattgtgaaaattcactgaactgtataagtttaagccattttttctttttttttaattgacaaataaaaattgtatatctttatcatgtataacatgttttgaaatatgtatacactgtggaatggctaaaccaagctaagtaacatatgcattacctcatatacttatcatttcttatggtgataatacttaaatctactctcttagcaattttcaagactatactagattttcattacctatagtcaccatggtgtacaatagagctcttgaacttattcctcctaaccgaagtttcatatcctttaaccagcatctcccttattttctacatgcctaatatatttcagtaaaaaagtgttttaaaaggtgggtataatttggttgtggcctttgtagatgtcaaagcaaaagaaaaaatataaaaggaaatatgatcgattttattatttggattattgataaggaggaaagagtgtaagtgaaacaaaggaaaatccaagtctggaatgacttagattgaataaacagatctgcatgggatctaaggtgggagacactgcatggtgtcgactttcagaaaaatcccttcagcagttttcagtgcccctcgacataagccaggaacatgatgccgaggtacacctgagttgaggcaatcttatgggggccaaggcaaagtggtctaagaatgcagctttctgatgacctggcctgaggtggagataaaactaactacagtgtttttcaaactgcaggtcatgaacccttagtacgtcatgaaatctatatagtggatcattaccagtattgttcttaatgaaacagaaaagaatagaaaatatgacagtgtagaggttggagtggggaaaatgggttataaaactacctattgggtactatgctcacaatctgggtaacaggtcatgagccccacaccttagcatcatgcaatgttcccatgtaacaaacctgtacatgtacctcctgtatctaaaatagaagttgaaattaaaaaaaaaaaaaaaatatgaaagtgtactatttggtatgggtaagtaatgttttgtgaaacttttctttcaatcatacaagcatgaatagacagaaaaagatttacagatatagatgcgtgtgtgcgtgtgtgtgtgtaccaggatgacatataaaattaatttttatagtggattggcaaaaaagatgaaagctacaggctttactacataaagaaatggacaaactatacatgcccactggacaatcatgcatcattataatttctctagactaggatttggaaagaagttgacggaagacagtttgcagtcttattccctggtaagggctggaacattacaagagactggaggaggattaaaagattcaggagggggagcaagttggggaggcgttcatcaagtctgaagttctaaccacatgagatgctgcaggggctgagaatctgctccaagttttagggggtgtcttctctgccagctgttcgtttgggtggctgtttgggagtataccaggaatcactcagcctttttgttttcttccaaatggcatggtgatattgtcacattgcaggaggaaaaacattgctgctaaaagtattgttaaggggagtaacaggtagctcacactactatacacaactgcacgttgcctgtctgaacaaaacacttcaaaacataaactgagaaatgcccttctgcttccatcttgcagtgagacctaattcaaagtccttgctagtgtgctcaggtccacgccaacaaattggcaagtgtgtgcctgacagaatggtcacattttagggctggatggtccccattctatttaatgcttataaattcatcctattaagtgcttggggaaattaatctgaataagtgtccatgaagactgataattatcatgatttttaaaagtattctcatataattgtaggaacattttagacagtctgcagccatgggggtattaagcatattatgagtaaaaataacagctttaagaataaaattcctttcaaaagagtgaccagctttgaaagttaccagaaggaaacccacaatctttcttttttcagtatttaatcacagcagctttcattaaattcccagtactaataagtggttaactatgtttgtaatcagtatttcttatatttttaaaagcactagattatggatgctgtatgtctaccattggctgtgaagccacaaacagtttagcctagcaatgattactcacaaagcatgaattttaacagcacactccattttacctacatctaaattcagaagagaatttagtccacagaggaaccttcctgtaacttttcttgaatattttgtgatatcttgcaacatggccaaaagttctagccctctccttggtgtccagctcttgcagtgtgcctttgtatctcttcccaccaacaggtggagtctttccccactccttacatctgggatggccctatgacatgacttgcttcggctaatggacactaccaaacatgacacaagcagaaacctgagaagtttccatgtgaactagcctgaactagcatgttggatgatgagatacacacaaacctagttgcatctgttcctagatgacagcctgtcaaccatcagacatatgagtcaggtcacgatagcttatccagctgccagctgactacagatgcataagcatgcctggcaaacagtagtacaactggtcacaccacataaatggcccaatccacccatcaaatagtgagctaagtaaatggctggccattgtgttatagagtttatgaactattgttcaaatttggtctatggcctgcttctgtacagcctctcagctaagtatgactacatttttagagttgtaaaaagaaaaagaatgtgcaacaaagatgcaaagtgctccacaaagcctatagtgtttactatgttgtcctttacagaaaatgtttgctgacctcagtgttaagccagtaagttttggggttggtctgttatacagcaaaagtagctgttacacatctgctcccaagaaagaacgttagaaactaggcctttctcacaaattcagttagcacctagtcaatttatccttggtgcatgtcctccagttgcttgttaataagataatgctgaaatgaacagaaagaacaaatacacatataacctgggaagttattttagtaatatgcttctcaaaagtaagattttataaggggtatttagaaaaacaagtatacaatttttagcagtcttattcataatatcctcaagctggaaacaaaatcattatgctgaatataagagaccagatacatacaaaaatactgtatgattctatttatagaaaattcttgaaaatgcaaagtaatacacagtgagagaaagacgatcagtggttgcctagaatcaggggtgaaaggaaaaatgacctgcaaaggggcacaaggaggcttttgggggagtaagaacgttctgtcatttgactgcagtggtggtttcacaagtacacatctgccaaaaatcgctgaaccactttaaatggaggcagtttactgtgtgtaaatttttatttaataaagtttattttaaaatttttttaaaaaagcgtttgccctaaaatcaaatttaacattcaaaaatgcatacaactgcacaaagaatgaggtgcatcacacaggatgtttacataaatataggacagattcaggtcatgctgtcagttcccttctgattaattccgaaaatatcaaaacattagattcacaagtgaccttaaaggttaatgaattatatcctctcatccaatacagaaattgcctttaggggtgagacagtcatttcagtcttgaaaatctactgtacagggagtttaatgcttttcaaagtggcggattttattttttggagagctcgattacaaaagtttctttaatatttagttaaaatatgctttcccataacttccacatatctagctcaatccattctcagaataaaacaggaaaaaaataacaaaagagagttcacagtagtaatgaatgggcaaaactggccaaatgaggtcttcaggcagagggctgagttgagcttaagagatgactgaagaagaaacagccatgtgcaaaggcagggccaacgacagagactctattttgtgttgatctagatctattaattgacattctttagatgtcattatttaatcagcttcaaattcagcctattagccagccccactgttctttatcttgtacccaatattctcaaaagagaacttgaaaaatgtggtgtaaaatcctaagttatgctgtctctaacagtcttctcatctaaccatcaagcagccataaaaaaaatgaaaatgaggtgcatgtgacatggcagattttgagagtatcacgctgattcccagcagcatgttatcctatgtaatcattaataatcagtacgatgtcattttccaggattttgttgctcatcaacatcaaacttattggtttgtaaattttaaaattcatctctttactttttaaacgttaaaaaaatgttttctaatctccttatatgacatcaccaatcccttcccatgttttctctgagttttccactggcaactcttttcatgggaggaggagtgacttttagtggatactggataagaagaatgcactcctgttgagtagaatgagatcccatggcagcacttctaacaaattagacctagtctctgaacaaaaacaatatgagttaagatcgtccctaagattatctagaaaagaatcccgttcccataaagctgagtaacattttggtcagatttgtgtcattttaaaagccaaaatatttacctaaaaagcaagtgatttgaatgtctcagactaagttattttttactgatctatggccctcaaatgagttgatgaccttcagtagagaaatggttctttatttctgatttgtgagagtcatgcgacagcagtggatgggttaagaaggttagaggaaatttgttacattgctttttagctgttgttttttagtttggtgaacaaacgagataacatagctagtgccttttagtcataaagcaaaaataaaactacagtgttttctaatattgtaccctaaacctatgcaaatctccaatttacatcacccacaagccttctatatttttgcagattttaactagagctaaataataggcatatatttatacttaattgtaatcaaatgtaatgacgtgtgcaaaacaggctttgctcaaagtgctctttatagatgaaatatgattattgaacttgacagtagatcattcattggagggaaaagtgattaatcacttctctgtgcctctaccttcctaccctttgatgacaccggttatatttcaagattctcaatgctataaatgaacactttactgaagaagcatctttatccaatgcaaaatgaaatgtgttgcctaagactaataaagtcatttacaagtttcaatgaggagcaaatataaatagtaaaaaaaaaaaaatccattatttaacagcagtaaatccagtatgttttggtaaaacagttttcagagaagctctacttacgttagcttttcctaaaccttgctgcaaagtgtcagttctttctaatatacaatcaaaggaattttgtgttgggaagaacatttctcatctttgtaaaggacatttagaggagagatagggaaaaacaaagatcatgcatgaggattatgtgtgagggtatggattgactggatttcaatcattattttaaaaggcttatctaaaataaggtgttctttgaaccaagtggagtctgatttccaattttagaatgtttccacatttaacactgacattcattatcctgaaaatgaaggcagatacacataatatctatatgtattttaaataaaattggttcaataatttttctcaaatttcataactttttctatgaatcaatgtgtcaactcattttttcaacttttcaaactgaaagaaattccattgatctttaataataatgaatttaatcaaatattaggcaaaattctttagtgaaagaactcagagaatttgattaggtgcctaaaatgtcatttttaacataaaaattaacaaaagcacaaaaatatttccattttatcttaaaaattaacatgctatgttataatacaaaaaaagccctcccctaccccagaatcctgcataagaatgtgaatggttatgtttgtttgcgcagatggggtttatatttatgtgtttcttttccatctagcaaatttaaatctaggatacaaatgtagtcattatcgtgtctgaattggtgaagaaagcccaaaatatggccaaatctacttgccccctaccttaaattatgagtttttaaaaatatattttcaggttagaatatttctcttttttctgagtttagctctctgaagcaagtgctatcaattcatgaaaatattaattataaaagttttatactgacgatttggtcctcataactgcccctgcttggtctatatttcaccttcatcatgatttattttctaatatgagattaatgttaaggaccataaacgttatgttgagaatcataaaacatgtgtgctaaattttgggaacagctcacgtatacagagaaagaagaaaataaaaagatctagcagataaagaaaatactgtttttggtcccatttagaaatgttattaacggcaatgctgtaacaccttcctttccaacacaatggcaagccatgggatgaacaagctcaagacatgtgtggtagcataccaattaagcaaacagttgactcatggatgcattactagcaatacttctgctccaacccagatacagatgctcttcaacttacaatgaggttatgtaccaataaactcatcataagttgaaaatattctaagtcaaaaatgcatttaacatacctaatctactcaacatcatagctcagcctagcctaccttaaacttactcagaacacttacgttagcctacagttgggcaaaatcatctaacacaaagcctattttatactaaagcattgaatagctcatgtaatttattgaatactgtactgaaagtgaaaaacagaggggttgtgtggatacctgaagtatggtttctactgaatgtgtatcacttttgcagcattatcaagtaaaaaaatcctaaatccaaccattgtaagtcagggatcatctatgtttgattgacaggccccagcaagcatccgcaaatgaggaaagaatagagagaggagaaagaaagtactagatgaagacaaagaatccttggtgataggatcttcagacagagaggctctagggacttgaaacctggaagttcagcataggcatttagtatatgttgagccttagggaactcatttatcaatttgatatcactcctttgtatcactgccatggtgaatgatcagaaaggaaacacaaactccttctttaagaactgcaataacgaactgtttcttcttcttcttcttcttcttcttcttcttcttcttcttcttcttcttttttttggcagaggtggggtgtctcgctaccttgactaggcaggtcttgaactgctggcctcaagcaatgctcccacctcagcctcccaaagtgttcggataaccggcattagccacctcctctggccaagaactgtttcttttgattaaattttgttcttcctactccaactttccttaaagataatgcttccttaaagataaatctaatggcttaaacacacacacacacacacacacacacacacacacacacccacacccacacacgcaaagtatgtattcttttttatcactctcctcctgtccctcttacaccttgctttggaactgactggtgccttgcatctccagtcatttatcacacatcgtgtagaccgagattttcgatattaaaacattcagtctgccaatgtacgtaggaagcaccctcaatgtctttaaaatgctattctgaaacatttaaagagggccatctgcaataagaatgatcattagatgatgataaacagtactgggtcacagatggagaaagtaatagtatttgagagccattttcatgttaatgttatagattacatattaaagaaatgtgccagtaatgaagcaaacaacaaagagggccattggagaagaacagttatgctattgaaagcaatgatataataagcagaatggccccaagccatctgtttttaaagcttaccatatttaggctgttaggaccattccactgtccatggaggtgccattctgagataacagggaagtgggcaaaactaatacaaattaaaccattgtcagtaatttttatcataaattgatttttccctctacaaacatatctaatgctcccaaatctgactatttaaaaaaatgtttcttagtccttaatgtatgcatatcacaactctgaagacactagaagtatagactatagggttcacagtcttaaaatgaggattttagatattgattttcattaacgctctcctctaaaatagtttcagtcttttgtgcttccaaaattagaactttatccttaggttttgcaatttggatcttgtaaggagataaagagggaagaaaaaaagtttgtgattcaggggtgtaataaactccagctggcatatcatgagcctagttatgtcaaaataaataaatgatcaaaaatcttattaaaaaacaaaaacatactggaactttggaaaataaatttaggtaaaacaagtgaaatgaaaataggaagaatattaatattcagaagctgattgattatgtattagccagatcaaagcctctgggtgataatgagccactgaacagggattaccacctgtcctgttcaactagcagctggacttaccaagaacagctggacaagaacacttatataaaattagcctttagaagcataagctaagttttttcacctgcttctcagatcggcatctttatcactcatgccagaagtaaaaagcttttcatattttgatgctgtttttgccttcaggaaagcacagctttgaacaccaatattcccagccgcttgctaccaagtaatggaggttgtcttctagacctaataagctaagatgtcagatgcacttggtttttcctgtcactggctcatcttgtgctcttatgtttaagccactacaaattctttcaaaagaaagtagaaatataaattataaagaaagattttaatgtcatttattcctatattcttactcacgaatcttcattttattgaaacctatttaaaatgacaatatatatgcacacttgggaagtttatcagataattttgatataagacgataggttaaaaataaggcatatgacaatctttatttggtgctctgaattgtattaaagtcaccagtctgttttaagagttatcatggaacaagtgaatgagtaaatataatagtctacttccttccttctcaaagtgtggttggtccacagattagcagcattagcatcacctgttagaaatgcagaacatcatgtctcattttagacccactggctcataatctggattttaacaagattcccagacaatttgtatgcacattaaaatttgagaagcaatgttcctgtgagcttaatcagatcctctctttctttctacacgttttttctttcttttttttgagacagagtctcactctgttaccgaggcttaccaaagctggagtgcagcggcgtgatctcggctcactgcaacctccgcctcccatgttcaagtgattctcataactcagcctgggattacagctgggattacaggcatgtgccgccatgcccggctaagttttgtatttttagtagagacaggtttcgccatgttggccaggctggtctaaacctcctgggattaagcgatctgccctcctcggcctcccaaagcctgttgggattacaggcttaagccaccatgcctgtccctgtttctccactttgtattggaatgcttttatttgaatatgatgttttagtacaaaccacagcctaggaggcctgggttttaaagtaactaatattgatggctactatgcctgctatgtataagtgtaacgtacacaggttgaacataaagaggaggtttcacataagaatattataggaggtatcgtgaccttagaacatctgtacatctgtataatggaacctatttctttcattagaccccaatctgaaaatttctctgtctgccaaaagaaacagagaatccttctactcccacaacgcaagagaggaaaagaaaaacacattctaagtggcaagtaactggcagcaggcactttgtataaataccaaaagtagcacgcgttagcacattgatgacgactccttatttcaaacctgcacttggaacaactgcagatagagactaataattcttgtcaatgtgtattaaaagctctgacaggagaaaacaacttgtgcagctcaagattgaaagaaagcacaatgaggagattcaattaaaactggatgatgggagaagaaagcataatctataggaggacaggtataaatcctctttttctgatttgtccagtctctactaaaagagattgaaagctgatatcagaatcctttgccatgctagttataggcatttatttatttaggtatttatttacattttttaattatatgcttttatgtataatcatgcttcaattacgtgtacagcaaatggtaaatatttctcatttatataacatgaggtcagtcattcctaatgaatcttttctggtgccttaaaacctcccaattaaagactccttcaaatactccagtcaaagacaccaattaaggattcctcttaatagataaatatccaaaccaggctgtcctcaaaatgataaccagtgtcaagattccagtgttcaaaaaagacagatcagtaagcagtctcccaagccaattgactgtgtgccaattccacccttggttgaagggagagaaaatgattgcttcagagcagaagcaacggtggaagcagaagaaacagacaaaaaaaaagtgggggcgggagaggagagagggttaagatgcaatgggacagtaagatgttgtggagtagtgtgaacccggaaatcaattgggaaatagaacatcaaaagaacacgccagtatttttgggtttttgtttgctcctctctaaagaaaaaattctgtctaccttagacaagcacttcaccagttaagtctgtgggaagcatctacttagggcaggtaggccaattggtatcttcaatctttttcaaaggcttaaatttaggcacatccaggagtaagaaagtccttcccttcactacgtgcaagataaagctggtcaatcgttgagccccagctgactaaattttatgtcaggtaaaggaagcaatgtgggtatgttcccgacaatttatcagataaccaagtacaatcccattaagataacggctatagtccttgaattgaagacttatagggccatgtagaggtggcttttgtctaaaaaggacaaaggaactgaataatgtggtcagttctctgccacagagacatgaagacgaaccaagagattttatgtgtgtttgctcattttgtcagaaacaacaggtgacttaattacatagacttcagttcaaaatgctaagaataactgacaactgacaactttggaggacagattcctaccaaagtaatcacattagtgctgctctcagtcattcaattagtttatgattttcaataaatgaataatcatataatagaataatccaaaatcttatttttaggttttttgtatatataactagtattaaccctctctgtcaacatttttgctttccttaaagaaatataagaacataaaattttagtctaggtgtggcggctcacatctgtaatcctggcacgttgggaggtcgaggcgggtggatcatctaaggccaggagtttgagaccaacctggccaacatggtgaaactctatctctataaaaatacaaaaattagctgggcatgatggcgggtgcctgtaatcccagccactcgagaggctgaggcgggagaatcacttgaacccagcaggtggaggttgcagtccactgcactccagcctgggtgacagagcaaaaaaaaaaaaaataaaaaataaaataaaatccatctcaaaaaaaaaaaaatcaaaatttaacactctgatataccattataattatttattgtaattgacaacgcaaatacaattttgcttatttggttgttctgttcgttgtaaatggagtacaaattctaatttttgttagctctaaatcaaattttaaaagtaaacagaatgtttaaagttatgttttatttgcttaacataacacttaaaacaagatgaacagcaaaatataagaccaggcctgaatccactgagctgtctcctctatgaacttcataaggcatcttacatagagtaagcagacagacttccagacttacagttagaaaatgctggtttgaacctgggctctaacactgtgatactgggggaaaaaaaatcacataatgtattgaaataataagtattgttgactataaaatggaaatctatcctacatattttacgatattcttttaaaattaaatgaagtaatatatgcaactttatgtaagtaggtactttataaactagaaaattaaataactgctaatttattttttagtttagtaaagtctacaaaaacatcacttaactatatatcaaatatagtcacttaggttattattctgtttattattattattattattattattattattattatttgagacagagtctcactctgtcgcccaggctggagtgcagtggcatgatctctgctcactgcaacctccgcctcctgggttcaagcaattctcatgcctcagcctcccgagtagctgggattacaggtgcacgccaccatgcctggctgatttttatatttttagtagagatggggtttagccatgttggccaggctggtcttgaactcctggcatcaagcaatctacccgcctcggcctcccaaagtgctaggactacaggcatgagccaccatgcccagtcttatttactattattttattattttaaaaatcctaatttcctgaatttttcctggaaatgcagataagtaggtaatgcatttggtgatggtagtattaatagtaatgagctaatacctcatcctgaaaatagctcaaagattaccttaagtacatattgactccctaaatatgtgaataacaaatataattgtcacataaatacaattatgcaatcatgtcaactaaatacaatttgcaaatattttgattgtttaaggttgtattttcagtgtactatttaacagttatacatatcttattagtctacaagactttagactacaaggacagtagtcttcatggtccctacctgcctagtatggcagctatgattatttgctgaatgaataaaaataatactctaaaaagtgtgttcatatgaataatttttcattcatgatgcctctatcctaagcatcttatatataggatcttaatccacagcaatctgaattccctgcaaaaattaaaagaagtctgatattccttcactctatataaccttgaaaagaaacaaggcaaaagcaaacaaacaaacaaacaaaaaatccagtaacttgaaatgagactaccaggtttgctttaggcaaggtaggctatgaactaagcaattttaaagcttggagtgaggacaatttaagtcaaatcagttttttggaatgtccacaagacactaagtatatcatgaaaataacatttaaggaaaaataagtacacaaacatgagagtaaatgaaaatattctagttatttgcagacttggatgtcttaaaatctaaacttttttaatatggtaaattaaatgacaaattcatatttaagtgtaaattaaataaatgtcaactataaatgaattatattatttgaaaatggaattatatctgtgctattacgcttttcattagttgaaagtacaagttgcaaactagcagactttgggctaaatttggcatgcacaaatgttttgattagcccacacagtttttttttttttaatctgaattactcaacatttaaatattcagagatattttacagaataatccaaccttctgacttctcatttaaaaggaatgatttgtccatgctgggctcctattcttgcatgacaataactttccggagccaccattctataacggcacatgtattctatagtccctaccagctcccattaacttacgcttcgctagccttgcccagttacagtagcaggctagcccctctgttggcatttcagtttgcaacctctggtttagaccagcaaaggctgaccatagcaatcttagagtatcttagtgtgctttaagtcaactgacactgacaaaagaagaaatagaaaattggaatagccctgtactatttaagaaataaacactgtaattataaattttcccactaggaaaattccaaggccaaatcatatcactggcagaaataccaatcttaaagaaactcttccagagactagaagaggcaatgcttccctacttgcctttatgaaaccagaataatccacataccaaaccttgacaagaatggcagaccaatataactaataaacacagatgcaataactctaaaggaaatactatcaaatgaattctaaatgaatgtttagcatcaagtactgggccaactagatatccatattatgaaaaataaaactcaatctctatctcacatattacacaaaaggtcaattccaggtgtactatatatctaaatggaaaagttaaaaaatagtaagtttctagaagataataaaagaggatacattcattatcttgtattaggaaagatttcttaaagaggacacaaaagaattaaccctaaggaaaaatttacatattggactatattaaagttaagaactatcaatcaaaaaaacaatttaattaaaaggaaagctataaaatgggagaagatatttgcaacacatacaatttacaaagggctacaaactagaatatgtaaaaaaaactcctacagatcaataagaaaaagaaggatgaatcaataaaaaaaataggcaagagactgaatagatacttcacacaacaggatatccaaaatggtcaataaatacacgtaaaaatattcaacctcataagtaatcagacaattgcaaattaaaataacaatgagattctactcacacactcactgcaatggcgaaaattttaaagactaacaagtatcaagtattgttgagatgtggagctactagaactttcatatactgctaatgatggtgtaaactggtacaaccactttggaaaaccaggagtatctactaaagctcagcatatgcctaccctcaacataggcaattttactgcaaagtatataccaaacacagttgtacacacgtgtgtgccaaaaaacgcattaaagaatgttcataggaggccttattcataatgtcttcaaactggaaagaaccaaaatgttccccaacaatagaatggataaattatagtatacattttaaatgggatatcaaattgcaatgaaaatgtatgacagattcatgcaacaacatgagttaatctcataaacacaatgttgagtcctagatacaaaaggttatatactgtacaattccatttttatagagttcaaataaacaggcaaaactcaaccatagtgttataaggcagagtagcagttacctttaagatgagggaggaatagtgattgggagagggaatgtgggtgaggtagggtggtgatttctgaggtagtggttatattctatgtttctcctcaagcttttcattttgaaaattttaaaccaattgaaatgttaaaagaacacccataaaccattcacttagactccccaactgttaacataatattcgctttctctctctctctctcaccactcccccaacccggtgtgtgtgtgtgtgtgtgtgtgtgtgtgtagtctggtttagtgtgtgtgtgtgtgtgtgtgtgtgtgtgtgtgtgtgtgtgtaatctggtttagggctactgataatgttttatttactgtcctagatggcgaacataggtgtattcattttgtgataattgcattgagctgaacatgtttcatctgtatactttctgaatgtgggtcattcttcaagcaaaaaaaagagattcaatcaacttattttttgaaaacgccctcgaaaacaatgcattcaatacaacacattactgaaatactatgggtaatgattttttgttgttgctgtttagacagcgttagggaaaaactacaccatattttctgatctatttattgaacaaggatacctcaatgtggcagtgaggcttgggttaaaattgttatgtcacagcctcacctgctggttgttttccgtagccatactctacacttgcttctgtattatatggagataagaaatctccccatacttgctgcttttaaaatgtttttaagacaaggttgttcagggcacagaatgagacacagagcggggctatgggggttactgccagtgcagggtagatattaaattgtcctatcagttaatcgactaagtaaaacacagttctgactccccctgccaaacaaatggttaaacgagcaagctaaagaaaggacataataggccaggtgtggtggctcacgcctgtaatcccagcactttgggatgccaaggcaggaggatcgcttgagccaaggagttcgaggtcagcctgggcaacatggtgagactaccccctgctgccatctctacgaaaagaaaatacaaaaaaaaggaaagcacataatattttccaaagcttagataaaaagtaggatagatgacctgaggatgaaaaagaaacataattatagaagtttttcctttgtgttgtttaccaacagaaatgaattaacaatacggcacaacagaacaaacacacagcttagacaaaagcaacttagtcccagattctagtccatagcaaatgatctaagatagatccagacatctcaaagcctcagtttccaagtctgtgggaataagaataatcatatatgatactcaaacattccatgggatattgtaagaatcaagtgtgataatagaggtgaaagtgttcgataaagtgctatacaaacacatggggctatctataagttatctacctgaatatatcctctacccgaacatccatggcattagaaagaccatgggatcaggtatcagaagatctggttttctagaccagtttagccatgttactaaaattactttccccttttggacttccattttcctatctgtaagatgaagagtttgggttggattatctttgacattctttcttcctcttacatttcacaattttatctcctcacatttgagtaaacgtacttctgcagtctaattagctgactgaatactgatgacccgttatagaggtgtgctttcagagataagttaaaggacaagcttgtaatcttagggtaacagttttgggagaaggagatccattcccttaaatgataatggcagaaatgaccactaaaggaaggcaagaagtatctggtttatggcattctgaatctatttccccaaatggaaatcagatgtaaaattcttgtgctcagagacgtagtgttgattgaagagtgcagatccacgtgattctcttagtgtcatattcatgtgtgtttcagtagtgtaaactcggaattgaatagttgcctgtgtttgtaagagacattgtaggtttgcttttttatttttattttttcttttgagatggagtctcactctgttgcccaggctgtagtgcagtagcgcgatctcggctcactgcaagctccagccccgggttcacgccattctcctgcctcagcctcccgagtatctgggactacaggcgtccaccaccacacctggctaattttttgtatttttagtagagactgggtttcaccgtgttagccaggatgatctcgatctcccgaccttgtgatccgcccacctcggcctcacaaagtgctgggattacaggtgtgagccaccgcgcccggccgtaggtttgcttttaatatactttcagaatgtgtgtgttagcatttttttttcatataacagctttattgacatttagtatacataccatacgattcgcccatttaaggtgtacaattcaatatttttgtttgtttgtttgttgagactcgctctgtcacccaggctagagtgcaatggcatgatcttggctcactgcaacctccacctcccaagtccaagcgattctcctgcctcagcctcccaagtagctgggattacaagcgctcgctatgaacgcctggctaatgtttgtatttttagtagagatggggtttcaccatgttggtcaggctggtctcgaactcctgacatcaagtgatctgcccgccttggcctcccaaagtgcttgcattacaggcgtagccaccacacccggccttgacttagtactttgtattggtgatatatggaattgatttcaacattttttgccattctagggtgaaagtgctacaataaattaaaaccttataccagccaaagaagaggcagctctcaattgtgaatgttgagaatatacttacaagaaaaatttaactttggtgatgtaatagcttcatttgcattacctaaagcttgaagtcaaaagctaaagtattaagcgtacagaagcatggactctatgaaagaaacaatccaaaaagtgacttttttttttttttttttttacaatgggagacattaagaactttggtaactaactcttcaatatgtccctgatgacagaccaaggatttatgaccagaagaagctattaagaaaatcttcctgaggtgttaaacattgaacatggattattcatgaaaagataggaaatctcttttctgaatcagaagagagtagattcttgttgatctggagtggtttccatttacttctgccatgggaataaactgaatgattgctctataattgaatagtcttttaaaccatactctataaattctataactatcttataagtatggtatctaaaaataagactgatagcttgaggactcatagttgtgaaaaactattgaaagtatcattgaaaaggctcaacgttttctattttcaaaaagctaatggtaagctattttttaatccaatggatgatggtttcagtaaaggcaattttgtcacaaagatttttatgggaatctgcagtatgtagaaagattctcctgaggaaacgtgcttactgctccctttacagtaggtcaagagtctctgatttctagcacagaactattttctaggcatcttttaaaaccctacctaaaggcagatgagtgggccctaatgttacaaagaactactctgagctaagtgaaagaattacagttggacaagtgggaacaaataacatggttcatagctgcaattactgctcacatgaattttacttataatattcctgatgccaagtcataaatgctctcaacatctcatctgactggtagaactttcttactggcatgagattcctaggatttttgttatcctttagcttttatattctacaccatggattggtaccactctaaattggatcaaattttggaacaatagacatcaagtaagatgtttctaaacaattagctattcttagtcatttgaatttctatgtcataacacatgctttggcatttatagagtaacctactcttaagaaaaaataatctcttctaaagcccgtatttaattttacaattgtgtatacacaattgtgtatgtatatagtaagcatggtcactgacaaatgctaatgtctcagccagggaaattgattgacaggaaactggagaagagcccctgaaaactcaagtctgtaattatatactacatctgtgagtggactacctgtatcagtttatacaccatcttccaaatcccaaagtttagtggtaaactaaaccttgtctgatgccctgtatggtctaaaaaagaggagaggggttgaaaagagcaagaggtagagtagagatgcaatctgaagaccgctattcccagagtgatagagcaagtgactagtagtgaatgtgagggacctcctgtttgtgtggtttgtctgtcatataaatcttgaaacttacatagatttttataagggaaaacatcagcatatcgagaagaaagatataatgtttaaggggatcattgccactggactttatttagattttggcttgcacattctatcagaatgaaaagccaacattgaaatcttttcatcatataagagaaaaaggaagatagtaggtgctggtatcacaaggctagaagcggttttcatagtagtcagccattaatctttcccttatgagtttgagttatcctaacattgtgcatattataaatacagacacctgcttggcttgtactgcctctcaacaaagtgatggcagacagaaaacctaaaaaagttcttttctggactagctgtggattaggcctagattggatcgccattagaaaagtggggaatgcatatgcatgtgtgcatacatacaagttctatgggcctacagtcctggagtgcacactgagacatgtggcttctgggggttgctgcctttcaataccacagaatcactgggttacagcccattggctgagtagttcaagttatctatagactcatttattatgtgacagagctgatgatagcatagatgcatccctgattgaaagccagatagatcctttgcttcattttgctttgttagtgtgggctagcacaggcttgcctttaggtacctgagtggaatgtacaacttctagtccttacatgtaatggagaagactgctatgattcatcttgaaaagtaaaatgtacacacatacctgtctatatccaagcttgggggtaacacttctgggtttgagctatgacatttttgtataataaatgaaaattaaacttcatttgaatttcataattacctactactggtgtgatttagaagcagctggtaggtcaatatggtgctcttttatgcattttagtactgagaaaaacataagtgctagatatgccacttttaaagtttcccagaatattagaattcaaacacacacacacacacacatacacacacacacacacacacatacacacacacacatacagagtaatagtggtaataccactgccagagactcagttaagataatattgttctctatttgactcctctttaattccgtctaaacatgaatgagaataatcattgacctatatctacaacatgactaaatgagttcaccagaggatctaacagcataaatctattttccatgaattaaattaaaaactcatgaatacacataatacttttagattgaaccaaatattttcatgaatacagactctcttcatccacgtaggaaaccctattggtgagcagcaggttggcaatgagtaaatgctgctcagcaggtcagacgtgtacagctggagaaagatcatgaaatttagctagtatactaggcaaaacacaaatctggaaaggagatgatccacattgcaatttttaaaaaaaattctatgtagacttagaggtctagtacagtacacatacacacaaggaacataaatatcttctgagagagtttctgtaggctttacctttgaagtttttttctttttctttttttgggaaacaaaacacaacaaaacacctcctgttgccctgaatgctaatgatggaagactgttgctatggtgatgctaatttcaacaccgttgcctgtggacttcacatgaactcgctgttttaacttctgcaaatgtcatttacaaaatgaaaacccattaatgattagcgagggcacaatgttccactttaattagaataataaggaatgctgatgcacaaaatacaggtttgtgaatcactactgagcctacactgtcaaaattaattactacggatgaggatttggtacttttctttttttaaagaaagctttagagtagaacagttgtattttgacttaaaaggaattgaaaactctctcttttaaatttgaaggtaaaaaaaaagcacatctccctaacagtacacataaaaactaactgcaaagagcaaaacaaaagttggaacctagggtcagatatttctgagtaagaactgaagaaaagtcaactaattgttcgtttagaaaatagggtaggctgggtgtgatggctcacgcctgtaatcccagcactttgggacgctgaggtgggtggatcatgaggtcaagagatcaagaccatcctggccaaattggtgaaaccctgtctctactaaaaatacaaaaattagctgggtatggtggcatgcaactgtagtcccagctacttgggaggctgaggcaggagaatcgcttgaacctgggaggtggaggttgcagtgagccgagatcgcaccactgcactccagcctggtgacagaggaagactccgtcttaaaaaaaaaaaaaaaaaaaaaaaaggatgggggggatgatacaggtaagctatttgaatatttcaaaaaataactatctgaggaaaaagtgctgcatatggtaaataccttgatattagatatatttggatttatgtgtccacacaaggaaacagagaacatttaaacaactgggaatatacaagaggaaacaaaaataattctattctctccaatggtaaaagattgagttaccttaaaataaagatttttttttcacctgcacaaattttaaagcaacatctgaagatgagttggaaagagtatgttccatatttaaatttgtttccacatggtttgctgcaaagactgcgtcggttgattttattttcgatgctctacatttccattctgggtcaccccctattcagtgaaatcattttatgtcattggtgcagccaacaaaaaaccgatggtgtatttgctggatatggaaggtgcaacacgcatttttcatgttacaaaaatcttcctacagaagttccaaacctgttggatttggcaagatatgatgaagggagatgataccaatactttatatagtttctagagtaatccttgaaagacttgtattctgggtcttcagtcaagtaatattatagggtctgtagaactatcaaattacctgtgttattgaggtgaaaggtgaatttgtggtggccttatttgtctacctgatattaagccaagggtactgcacttgggaagacagctgacatctgccgtcaaaaatgtaaagtaggaagttagagtatcttcgtatttaggtttaaacttgcattgctcaagaaaaggtaggatacaaagttatataaacaatatcttttgtattttatcagcagattttaaaaaactggaagaagacattaccaacatgttcattgcagttgtctaggtggtgatgggcacttaaatatttttaatctttttctatgttttccacagtgaacatttattatttttgttatgacacggaaaacttacaaatattaatttctaaaatgtattgctcagacttccagtttcaacttggagatggagatggagagctgcaaagaggttgctcccatacttgtagcaagaaaactgctggacagataaattaatgacttttcatcagtccatcagagaaatgacattatagaacaacctgaaatctggagagagattggcctttagccagaagcagtgcctgagcatttggatccctggagcagatgccatataaactagtagggagattaaattgttgggggacatgtgggagctagcctgagagtgtgaagatcctgggggctactgccataggtggagtcccaaccttttgcaagcttcttccttcaggaactgtaccttgccttcacaaggaggatgcgaagaatctggagaaagcctccccaacaccctctgtgttgctgattggggaagggtcacagtagctagtcaccatgaatctgcttatacccttctcttcagaggaaaagacatcacattgctataaagaactacccgtgactgggtagtttataaagcaaagaggtttaattgactcacagttctgcaggctgtataggaggcatggctggggagccctcaggaagcttaaaatcatggcagaaggcaaaggggaagcaagcacatcttcacacagcagcaggatagacacagtgaaggggaaagtcctacatactctcaaataactagatctcttgagaactcactcactatcacaagtacagcaacggagaaatctgcccccatgattcattcacctcccatcaggcccctcctccaacatgtggggattacaatttgacatgacatttgggtggagacacagaaccaaaccatatcaggcactgaggaaataccactgcattttaggggaagggaacaccagatctcatctatgtgtggttttgttttgttctttttttgtttgtttttttttgtttgtttgttgttgttgttgtttttcagccttatgcaggagaaagggccttggggccatagactgagaacactggtggatatccactgcagctccaggaagggaatgggaggttgaagttactctacctctggaggaagggaaagaaataattgtaaagaccacatccccaagacccaggccaactgtgtattaattcaaacattagagaatgcctctgcccgacactcaaccactacactaacaagcttccaatgaggaaacaaagttaccagaggaatttgaagtctctggtggccacagcagcaacaaaactcaacaatgacaaccaaagcaactaccaacatcaaacacagcccaattcccagtcagattaagataaattaccatgtcaaaggtttatttacctcagtatctattacgctatctaagatgcctgacttttacccctgagatacaaagcatgcctaagcaagaaaaatcacagtctaaggagacaaagcaagaatcagaaccagacttagatatgtaacagttgttggaactatcagacaggaaatttaaaataaccataattaatattttaaagactcttgagggaaaagaaagacaatatgcaagattagatagaaaatatgtaagattagaagacaatatgcaagattagatttgattcactcttatagtttccagctctatatttcagtatatttcagtatagagctggaaactataagtgaatcaaatggaaatgctagaaattaaaagcagtaacagaaaagaaaaataccttagatgggctcatctgtagattcaacaaagacaaggaaagaaccagtgaacttgaatatagggtaacagaaattatacaaactgaaaagcagggggaaaagtaaaaaaaaaaatgcaattgcaatacaaacacagtaggttttcagtattaagtagggctctaggaaacagctatttttcagattaagtaacagtttggtgcaattatgctgatcaagcataaagaactataaattaaagacttcactcaaagaagacctctgacaagcaaccaagttgctacaaagtatttaaaaagctagtgaccaaccagttgtttacagtgatatattttgcaatatttgatttagattaagagttctaggaaatacaaaaagatccacagtacaaaaaaacaaatgtgttccttctaatgctcagaattaacattttatctttgctcaaagcttcttttgaaataaaatacaccattcaagatgaaattccgatcctctctgatgccccctctcccatactacaactagtatcataactttggtgtttatctttccaggcttttcattttaatttaatttttaaaaattagtcttttttatttttagtattgcacctgtacttcaaaaagcaaaacactttaaaaagtgaccttccagaatttagcatcagaatctcattcacactcatggtttcagttactagctatatacaagtaatatgtaaattagtgactccaacccagatgcgcctccttctttctttaggtgcacactatctgtctatttacagtgctttttggatgtcaccaatcatttgaaatccaaacatttacaatcaaattgccaccctaaatctgatctttctttagagttccctaactcactgtaaagaattaccaactgtgcattgcccagaaatctaggtgtgattccttgacatgttttgctttctctttgcgcccttcctcctatgatatctatcctcaaatcttaaggatttttacctcctaaaaatctctcaaatctatgcctttctcaccatatccaaactatcatcatcttggtccaaatcccatcttctctcacctggctttcatcagtaaccttcaaacgtttgtattcataggctcctcatccaattcatttgcatcagccagaggactttttgagttttctcctcacctcctccagccctagtcatgctgtccttttaatcccttgtattgacaagttccctcctgctaaattgccttgacacatgactctctctctctttttgtgttaatatgtattcattcttagtgtcatttccattatctattccctggctatactttggaggtatcatgcatgttgctcaccaaatgtaccctttacatctagcaatgtatctggtgcacatattctgataaataaacatctattgacaaatgaatcaatgaatgaatcagtcaagagtatatctttagataaatgtttttcttaggtaaggagaatcaaaccatttaagtgcattagaattaaaaagcattttagcatttgtgagaaattctgaaagcagtaacaagtagcagtttctacttttacaaatataactgaggttaaacaaaatatacccagtaaaaaataacttcttactaacttggctaattatgggtgaaattggtcatttatgctgtgacaatgatcagagacacccttggaaactatgcttctttaaggaataatgatgccattttatagttttatgctttcattttagcatttgagaacagttcacaaacacactaattaatctctgcaatgatattgtactcctatattacaggccaattcaagaaagtaaatcacacagatttcaaaagcataggaaaaatttttagatgcctaagaatatactctttacctcctgtaccttgttatatatgtctttatagtcttagatagatctttaataaagaattgaaacagaaacagagatccttattttagctcctttatgtaaatcatatgcatatttatgacttagttcctttattttgtgagcattttatatatatatatatataatataaaatataaaatttacaatagctggtacaatagcccccaataaatatagtttgcttaattaatgtaatgaattcattaatacatttgccttttgcaaaacagaaactagctcgatattgtgaagtcccagggtttcctccctcatcccaatatgatggcatcccaccccatgactctaagaaggatgtatatattgatgattacaaaagttaaagctcttgtcctgacgtcttcccctagcttcagatccaaattttgaactgcacagctagatacccaataagtacctcaaacttaaacatgtctaaacccaggcagctctagggtttctacacggaagagtagctatctagttgacaagcaatttttttttgtttagattaaatgttttcctgttgttgctggaagcaaagtatggctaatgggcaggtattattggagcacagaagctcttcaagccaccctttaagacatctctttaaaaaattatttatttcatttatttgtaattgacaaataatagtttgtatatttatgggatacgatgtgatgttttgatcttggtatatattgtagaaagagttgatcaagctaattaacgtatccattacctcaccaacatatcatttattttttgcggtgagaacattaaaaatctattcttttagcaattttgaaatatatgagacattattattagccatggttaccatgtactgcaatggaacactaaaacttgattttccctaccaaatttgttcctctttaagtacctgttcctgctgaaagccgaggagacacctggattgccctctttctgtccctcctgacctccaatgcatcagcaagacctgtgattgtttctaaaccatattccctgattccaaccacctcttgtgatctccactgctacctttatctagatcttatctaacaccagtgcttcccacactactatctggtctccctgcttccactctggctcttcatatttcctcacccctaactcacgtgttccaccaaatgcattctccacacagcagccaattatgtcttgccaatctagtctactttcaaactgcattataacaaagcaccagcaaaaaaccaaacacctccaacaaacttcacctaggctttgataaaggtcaaggtttgcatttcaaaaattttcctctttggagttgcagaaaagaaatattcagggctgaatttcagcaaccttcttattagtatttacaaactagttatacttggctaatttgtaacaccattgaaagtgaggtttggcaataagtgtactttacattgtgaacattaaaaacaaacaagacatattgtctggcaaaatattttttgctgttgttgttgttgtttgaaattgtatatatttgaactaccttaaaagataatcagaggaagtcccaggtagctggacatttaaaagtttgtcttttttctttgaaaataatacatgaaacttggaaattgggaaaacatatttactataatattcaagtcaaagaatggagaattgcccaattagggtttatataaaattagttttcaaatttaaaaaaaaatccagactaaattatatctttataatgtataacccttaagagttgtttatatatcttctggttggttcataagcggaagagctgctgcactgttcagtatcatttccccatatttcactgagaaatgaagttcagagagtaatgaaattatgtaagggcatacatattattttataacatctatagaatttacatctttggactctcatgcctaaatttaatttcctattggtttattatttcatctccgcctgacttctgtgttttatatcccaaattaaatttcccacagatttccttaggtatattattactctataaaatggcaataatctgttcactatagccaacactattgcttaatcatctttgtaattattttatcatttctctattttttgttttgtaatacacatatttaggaaaggacaagtaaaccaaattcctaaattgacaaagtactacgtataaattaaacagaagttggtacagtcaagcatgaatctctgaataaagccaccaactttgagaagtgtttccaacaacctcaagtactttttttcttcactccactctttataaaacttggtgataaaggtgttcacgatggaactaaaagttatttggattaaaatattgctggtctgggattcatgcttccccaagcaatattgatttgctaggggatttttttctgttcttattcagtctttttaatttaaaatattttatatttatgttgctttttttctgatgttttactgaattaattctatagtttccaggccacggcaactactgtaagggtatggcccatactgtcagattatattattcagtgttcctctgctcatctcagatccttcagaggctgctatttttacacgttctattacacatcaggacttttaggttttaattttaaagaagtgttccacatttgagccctctgatataccctgagttatagttacagttacagttacagtcagataacttctcagaaaaaatgactttgtagtttgaacatgttttctccatccctccatgttaattttttccagttcacaagtgaaaacaagattagtatgctctgaatctaccagtcagtatgtttcatcttccacctcaacattgaactgcttcctttcaccttatacatctttttaaacaatacattcaaggacttggaatataattggcaattttgttgatgatgaatgaggctgagcaatataatgatgccttttgctactctatagtgctttcagtaaaaagaaatggcttgaggactaagagtatatgaaatatgagtgagagaaaaagctctaaggtccttgataataaagcacctttaaaacgatatcatgagatgatgtttctccctaccaaaaaaaccccaaaaaactatgtgtgaaaaaaaaatcggctctcttgtatcaacatcgggcattcatgcaattaaaatcttttgtatgtgtctggtaatgatatctaatatttaacagagaaaggcaaaaactggttgagtataactgaattctaaacttgaagtcttttcttccctactggataccactgcagctctgcctcaatgtatgtcttaggatttaccacttaccttactccaacttttttcaagatctattaagacagtggtccccagcctttttggcaccaggcatgagttttctggaagacaatttttccacagactgggaggcaggggcgggggtatggtttcgagatgaaaccgttccacctcagatcatcaggcattagtttctcataaagaggtcacaacctagatccctcgcatacatagttcacaatagggcttgtgcacctacgataatctaatgccacgactgatctgacaggaggcagagctcaggcagtaatgttcacttgctcaccactcacctcctgctgttccagtccatggtccagaggttagggatccctctattaagacataggcttacatgcattcactgaacaatgctggctcctgaagaaagcttgggagttttgatagaagaggattttaaggtgttttcctaagatattctcacaacagttttggtaataggagctactgaaggaatatattcacttaaagatgctttcttcaaaacagtaactttcaaagatttatagtttatagcataatctagccaggcaatcaaccccatcaacactcaaccccatctgctctcaacaaactgaaatatacaaaataaatggactgctaaaaaatcgcttccaaatgtaatttaataaactgtaacaccagtggggctatctagaatttaaaaaaataacatggaacttctttatctgttattgtctattttttaaaaattatttatttatttatttatttctagatggagtcttgctatattgctcagcctggtctcaaactcctggactcaagtgatcttcctgcttcggcttcccaaagtgttgggactgcaggcataagctgctgtgccgtgccatctatttttttgtgtgtgattttttttttctttggagatggagtctcaactctgtcgccctggctgaagtgcaatggtgcgatctcggctcactgcaacctctgcctccagggttcaagtgattctcctgcctcagcctcctgagtagtggggattacaggcatctgccaccacaccagactaatttttgtatttttagtagagacggggttcaccatcttggacaggctggtcttgaactcctgacctcaggtgatttgcccacctcagcctcccaaagtgctaggattacaggtgtgagccaccacgcctggactgccatctatttttctttaaataagcatacctattgggatcatagctcagcttccagtgcttaatcatcaaaatcaaaacaaatgatcaagtatttattattatttttacatgtgagatatataatacatgctagggatgatgcaaagatgcataaggcacaagcgttgtcagagagtttacagctgaactgaggagacaagggatctgaaaattaacaaaatatttcaagagttaaacaagaaagaaaacttggggtcttagctgggacgttatagaggctcttgctatttctaggatctgcttaaaataaggttaaaaattaattattacttatataattttaaaggtagacatgtataactgttatatcacttcctagtcctgaccctggccttttcttagacttgtgatttcctaaaacttgggacaagatgttaaggaaaaatatgtaggcccgctcatcctcctttttttcccctcttgctcatggcaaagataatttttaaactaaaataaacacaaattgtgtaagtataacatttggatctcacatcagactcacacaaatctcagattcttatctagtaccaatctttattaatgactgaaagaattatagggaagtgctgggcacagatagaacattatttccctggggaacctgaaataatcacacatgcgtttccaaaacatccatgttatttcccattatgatgtgctttggtttcatattaacagatacgtttttaaaaatttacacagaaacattgaaaggaaatcatttcagtctcaaaagttttccattttataatctgtcaattacaaaaatagaaaaacgttcatgtagctatgccctattctccagccagccacgactcataaatccaaacattccaggtttatttacaataagctatctagccaggccaggtataccctactaaaatcattttatagatagggatttgcaggtatctttcctctagttaaccactattaacaagataaacaagaaggtctgggaggtcattaacatgtttatgaagtggtctattaaggtcatttattcccttcacatcccccagggaataagtcacagacctgctgttaataccctttattctctttagtttcctcttcgttgtcctctctctctctctctctctctctctctccatatatatatatatatatatgtgtgtgtgtctgtgtatgtatgtatgtgtacatatagatatatgagtaaaatgtacacaaattacttttaattggatgcataaagatatttccaccttgaacttttgctgtgcctgctcagcccctcctgctctatctaggattcattcttttctattatttgatttttttttttggcagaaaagttcttgtagtattgatataagtaagagcgagaaaaaacaattaatctagcctttatttgataaagcacttgtatttacatattaacacagggtgcctacatttttcggatagagatttttcttttctttcttcttttttttttattcctagagacagagtcttgctgtgttgcccaagctggagtgcagtggcacaaacacggttcactatagcctcaactttcggccccctgggctcaagcaatcctcctgcctcagcatcctgtgtgcctgggaccacaagcacatgccaccatgccaaggatttttttttttttttttttgtagagaccaggtatcattttgttgctcaggctggcttcgaactcctgggcttaagtgttccttctgctttgaccccccaaagtgctgggattacacgcttgagacactgtgcccagctatattcagacagagatttttcttaatcttcagaaaacataagccattatttatcttcaaaaacatattaattgcccagattgcttttgtaattttgagtcattatgagaaaaagtatgagaaatacttcttttgcaccatgtagttataatgataaaaaataaagactaaagaatatcactctgcaataatgaatatcattctgcaataagaataaagtatcattctgcaataagatgaaatgttctgcatgtaatacatgggcagactcagtattcccccagctcaaggcttgggagaaattgtgacttatagccacagaccatatatatttgcctagtaaagctagaaccataggcctctggcttaagggaaggatgagacgatctgttctggaatggggggcggggggtggtgtcaaaatcaaggacatgcacaaatgttgcaaaggctcctgcagagcacttcttgtccatctaaattgaccacgcgctacctttcagaaagacttacaattgagggtatgaagagaaacacattccatgacatttattaagtatggtcttggccatactctctatcttagggaagccctgatggaggtggtggaatatgacttagaaatcctttgcttttctgctccattggtctatatgtctgttttggtaccagtaccatgctgttttggttactgtagccttgtagtatagtttgaattcaggtggtgtgatgcctctagctttgttctttttgcttagaattgtcttggctatacggggtcttctttgattccacatgaaatttaaaacagttttttttttaattctgtgaagaaggtcatggtagtttgatgggaatagcattgaatctataaattactttgggcagtataaccattttcacgatattgattcttcctatccatgaaagacctcagaaataataccacacatctacaaacatctgatctttgataaacctgacaaaaacaagcaatggggaaaggatctcctattcagtaaacggtgctgggaaaactctctagccatatgcagaaaacagaaactggacccctcccttacagcttacacaaaaattaactcaagatggattaaagacttaaatgtaaaaccccaaatcctaaaaaccctagaaggaaacctaggcaataccatttaagacataggcatgggcaaagacttcatgacaaaaacgccaaaagcaactgcaacaaaagacaaaattgagaaatggaatctaattaaactaaagagcttctgcacagcaaaagaaactatcatcaaagtgaataggcaacctacagaatgggaaaacattttttcaatctacccatctgacaaaggtctaatatccagaatttacaaggaacttaaacatattcacaagaaaaagacaaacaaccctatcaaaaagtgggcaaaggatatgaacagacacttctcaaaagaagacatttacatggccaacaaacatatgaaaaaaagctcaacatcactgatcatcagagaaatgcaaatgaaaaccacaatgagataccatctcacaccagtcagaatggtgattattaaaaagtcaggaaacaacagatgctggctaggctgtggagaaatgggaacgcttttgaactgttgatgggaatgtaaattagttcaaccattgtggaaaacagtatggcaattcctcaaggatctagaaccagaaataccatttggcccagccatcccattactgggtatacacccaaaggaatataaatcattctactataaagacacatgcatatgtatgtttattgcagcactatttacaatagcaaagacatggaaccaacccaaatgcccatcaatgatagactggataaagaaaatgtggtacatataaaccatggaatactacgcagccataaaaaggaatgagatcacgtcctttgcagggacatgaaactggaagccatcatcctcagcaaactaacacaggaacagaaaaccaaacgctgcatgttctcactcacaagtgagagttgaacattaagaacacatggacacagagagggaaacaatgcacaccagggcctgttggggtttgggggttgaagggagggaacttagacgatgggtcattaggtgcagcagaccaccatggcatacatatacctatgtaacaaacctgcacgttctgcacatgtatctcggttttttggtgtgttttttttttttagaagaaaaaaagaaaaaagaaggggggagatctcattttaattgatttagaccagaatcaaacattttaaaaattaaaaaaaaaaaaaagaaatactttgttttctcagcctgcagggaggtagaagagtgcttacatcagggctggccaagtttttgtttcattttgttttttgttcccctttattgcccaaagcagcaaagagtaacttaggtctctgcaacttgattgcgaagatacgccaaggaaaatccacctaacagtgcagggaaggactactagagtagttttggtgatgcccaagatggcagcctcacagtggtggattggccacatttggttatacaaatggccagttttcaatcaaaaacattagaaagttgaaacagctagaagcaatagctgagatgatgatgattattttatttgatttatttatttttattcgtataaatttctgaggtacaagtgcagttttgttacagggatgtattgcatagtggtgaacctgggcttttagtgtatccatcaccaaagtagtgcaccttgtacccattaagtaatgtctcattatccacccctcacccagcattctgcccttctgaatctccaatgtctatccttcttatcatgatgattttaagtatcaattctcccccctcccctttattagaatgacttggataagcctccaacttttttgaatctcagctgtttcttccttttttttttttttaacttttatttatttatttattttgagatggggtctcactctgtcacccaggctggagtgcagtggtgtgatctcggctcactgcaacctccgcctccctggttcaagggattcccctgccccagcctcctgagtagctgggaccacaggtgcatgccactacattcagctactgttttgtatctttggtagagatggggtttcgccatgttgcccaggctggtcttgaactgctgagctcaagtgatccacccaccttggcctgccaaagtgctgggattacaggcatgagccaccacgcccgactgatagccgtttttttctttattggataataagtggagtgttacaaggattaaatgggaagatacagatgaaacactttgtcatttagcacatagtaggcacacattaaactttgcttttcttcctgtctagcagattacatggacttatctatgagacacactgtttacagaaaactcatgaacaagaaatagtgaccaaaaggaaagaaaacaacaaaacgattccttctaaagcaacaaagaagcaagttaaaaattacacattgcactgaccatctgacatgcaatggctttggggaccaagatggatgtggataagctgagaaagaaaaacagaaaaaagcagttgagagtttcaggaagagcagcgaggcttttcagtttcatccccccaggagttaatggtatcacagaaaacgtgatcatttgccgaatgccgacagtgagctaagtctcatctaggacctgctcttagaagctttccagagtcaatatccagagatactgtttttctatcttgtacaacggtttaaaaaatttgcaacgtgacagcactgatttatacaatgcactcacagtctatttctttaaaaaagaatacatacacagagagagagagagagagagagagagagagagagagagtgttttaccgtgttaacatttttcctgaagaaagtatttaataccctctccctaccccctactcccccaccctatcccctggaaggaaggaggggaagactgaatgggatttggagttttcccactgagaaaggggcattttctgcaaccaggtcagtgttcaaaggactaatgctctaaggaaattatcccaaagaagagagaggcagttcagggttattaagttattttaaaacattgcctgggctgttgctgctgacctttgtgaagggaacaggatgctgcttcccaggggaacagaataagaagcaattagagaagcctaggagaggcccgggaatgtttgggaattcacacataccccaaattacgtgggaacgctaagaatgaaaataaactaactttgattagggacatatttgggttctagaaaatattctaaaaatgcagctcacactggggctatatctctatgagtgttttcctaaaaacctgaacactcagtatctaatagaggtcaataagacttcaatccagtttcagaggagaaaaggaaagccaattaacatttcttaagcaatattccttatgtgtcataaagtagaatgggtgtcacgttaagcaaatggctcaaacgaacagagttgggatatgatacagttgtttcaaatgcagatttatttgatgtgactactggtttttttctaacacgtgattatgtaagaaagtgcatgtttaagaaagttagaaaaagaaaatggggaaatagctgaaataatttactcctcttcttttggataaaccaacttgaatatgttctatgctcattctcacatttccaaaagtgccacgaatgaggcagggaatgctataccatgtgtattataatacaggattattttccccatacacacattaaattttagctgccacatgtataggtgtatgtatatatgttgccacctttccacatgacatatgccatatagaatgttacaacatttttctgtaaaataaaaatgtatcattgatgacattctgttaagactcagtggctactatatcctggcccaaaaagtaggtcctgtccacaatgctcagtgaaaaacagtagttgatcaatttaaagctctattgaccactagaaaaccagaagaagcctcatgaatgatatttaggaaaaacagactctagttctactgaaacaaagctagagctgagagtggtcccaggcattatctagttcaaccttctcattgaggttgagctaagttatactccttatcatattgttagattaagatagaacggaatctagaactcatgttttggtatgtaccattcatacatccatgccaaggactgtcccttaagcaccaaactgtaggagctatgagaaactctatcaaacactcggcatgcttcctaacactaaagttcatgtctagagggcatgagagatggatttgagtggtaaatctaaattgacacacaaatactacaagattgttttgaaggtgaaatgagtcagcaaactgaaaagcacatagaattactgacatatgttcatgaattcattccaatatttaccaagtacctgttatctgtgaggcactatgctagaaaaagagataacaacagctatcctcctggagtctgttatttcagtcaaggtgatacaaatcagcttatgaaactacaaaaaaggatgtgagggtttttttcatgaacctatgagacacagatgatatcaacatctacatctcccaacaagatctataaaaccaaaaccagactcagcactctgcacaacactatggcacccctttcactctctttcagttaatatcttaacctgaattgttttcatgattatatcatcaataatgtattaccaactattccttcattgtggttccagagcttactgagactcaggtaacgtgacctttgaaaccatcaaatggcagaggagaaaacacagcagagaagattgacctctgggttatctttgtgtactaaagccttttgaaaagtcagagcatcaggcttttggcagtgatttcaaaaatttaattaccccgaatcattcaccagcatcctcaaagactgacagatcaaattagacagctgattctctgttgcatccacttcttatcatcaatagtgctaaatagttaagtgaaacatttaatattatttgtcctttctatcccgataagattgatggtgcaataagaatcctcaagggcaatatgaagattcattttcacttctctggaaaatgatcacaaacaatttctatttcgaagtcaacattcacaaaatcagaaaatgttagtactggaaatgacctatgatatcatgtcattctgcttccttaaatgacagagggagaaactgaggcccacagaaaataagcaatttcccattggtcaagtattaatagctaggtgacagtaaagctggaactagaattcaagtcttgcgatgcctagcctatttaaaatttcccctatttaatgttgtcttagctgctaaaaggtatattttgaagaaaaatatacataagaaggatcttaccagaaatagcacaaaattatatactacatgatgtgttcacattgtatgaaagattatgacaaaattcaactgattttcaaacccaatgtcagaagacttgtatcattcttagaagagtgaggtgtctggaataagaaatgaggaaatttttttttttttttttttttgaggcagagtcttgctctgtcacccaggctggagtgcagtggcgcgatctcgtccactgcatgctccgcttcccgggtttacgccattctcctgcctcagcctcccaagtagctgggactacaggcgcccgccaccacgcccagctaattttttgtatttttagtagagacggggtttcaccatgttagccaggatggtctccatctcctgacctcgtgatctgcctgcctcagcctcccaaagtgctgggattacaggcgtgagccaccgcacccggcctgaggaaatgttttctatgttgatatcatactccagtttctttataataagagcccatctcattgtcagaagacgtgtctactgcaaaccagccaacacagggatatttaacacgttgattgctgttaaggctaagatgtagttaggcactgctccctctgtatataaatacaggtactgaaatagcaatcaatattatgaaggaagaaatcaaccaaccaaaacttgaattggagcaatgcctggtaccaacaggggctagaacaagaatgagagcaagatatgctttaagcatgggacatatttggaatccgaaaaaattgccatgaaagtagtaatagaggcaatacagtagggggcaggggaaggtggtgtcaagattcagatgctactggagttaggggaacactggtactaaaaaccagaccaagatccgtgagttcaaaccagaatgtagaccaacaggatacagagagccacatataccaaaaggtaaatctagacagatggccacagttccaggcagagagtcaaatactcgtacaaatagagctataggaatggtaggccataagaagacaggacagtcagaacccaaatcagcaattttgtcagcacaaacagcaacagtaacaagaaatgttgactgaagcaactgttaacttcatccaataaggttttatatcgcattttgctaagcaggaagcagcagaaagttgtgagcaaaactcagatgcaataaatggttgtggaaacatgcctgagattgagagtgaagagaagggtcgatcaaggtcatcaggcaacatatacagcaatgtatatacaacattcaaaattaccagcaggaaaagataaacactcctttggacatgagttgcttcttgagcattgcatgtaaaaaaagctgagcagttagcaagttcccaagaaccccatctttcactcttctgtgaagggcttcagagatatttcgaaagggaacctgatgaaatgcattactgctgatggagtcagcaggtttactcctgagtttcattagtgaattcttcccaatatttagcaaccacagcgtctttgaaggaggaaaggaccagcttgtctaaaaatcaaatccttcctaagggacagctggcagaaatataaggtcaaacacttttgctggtattacagaaaagtagcagaaaaccaaccttcggctagaactaatatatgcagaagaggttatgacctcaattgatctctccatttctgcaccaatgggagacagcaaataacatttactttcttcatgagtgagtggaaactagagacaatgctaacaaatttcataaccaatatttgggccaccctagtcacgacatcccaaagaagatataacagagctggaaaagatccagggaaaaacaactaagataatcaaggggaaagcttatctttccgtcaaggacagactaaaagactaaaaaggattagaatttctcagactgggaagatgaaaatgaaaagcattagtaggggaatgtgaggctaaagtcgactctggataaatataaatgtttttactgaatttcaaagaatttaattaaggccattccttgaggttaaaggatgcagattcaagagaaattaaaatgcctatatttatatagaagtcggtacatttatggaacatattattattaagacaaagctgaagtggggaataggaaaagtttgacaccattggataaactcactgccagttgatttacaatgcattattaagaagtggtcatgatgtatccgaatttttaaggtaaaatgtactaggttacctgacaaaacaaccattggtatcttcatctgggacagagttccgggctagttgccctgttggtctgacccagtgtgatatttcttatgcttttattatgacatctatactggaacatcctgcatgcatgtttgggattcctaaattcttttgacagtccagaatacagaagaacaattttctaactcattaagaaagcaagagagtcccagctcttggctctgtttggtttacccatatgggagcatgcaacataaaaaggtgaaagaaatcctaacagaatgcagcagctggttaaaggctattatattgaaattttcatgagtttgacagtaggccaaaaaactacaaaatggcagagagtagaaaaggcagttgtaacaggttgaacattgttggtgattattttttcagtggcaatgaaagctgtaatcaaataacctgaaagagatgctggcaggaataagggagccccaagggagagggaatatgaaaactgtaacaatgatgtatgctgtggacaaataaactagacaaacacgtagtttgaagtatcaaaatcaaggttcttagcctcatatgaaaagctgatgtcaggatgcaggcataaacactgcctgatttgcaaactagagcaaaagatgttaatgacttaaaatctcaagaatgagtgcacaattcaacaaccaacaggaactgtgccactggtatagaaacctcttgttatgtgggcgatccctttatcccagcattgaaaagaaaaagttacaaagcattaaaaacatagccagagaagacacctggttttgcagctgggcatctgtggtaaaaactcttgactggaagtcaagacaaacaagataaaaaagaggaaaaatgaggactggttgaagcactgtcactgtaaacgtatttttgttctttttagaccaagacggcatctcagattatgaacggcattaagctgtgcataaagtccaccgaaccttgtacatcaaattaatttggtttccatagaacattttagataatagtaatggctaataagacacaagtgccattaatcatctgcttactgacaatgttcattttataaacatgtatgttttccctatattacagtttaacattttacactcatatttgagaaattataccatccctaatttcaaagagattataattgtagagagaattgctctccataaggtttcagagatatttttgagaaattacgtaatttcctcatttcaaggaactgattatttcagaggcttttaaggtctccatactcaccttttggcaaattttcctgcctattgttctctctctcttatcatgagccaggaagcataataatcctaaattatataccaagatttgagctctttaaagaggtgtgtggtgaaattggagtgggttgatagggcatatctaaagctaattaaacagtggaaaaataaaattcctgttttttaaagtaagaatttacattatgttcattaaaataatgaattttaaaaataaagatattatcgaacaaaagctgagatcttcggtttttaagtttggacaggacaactgaatgagtcatgctcattacgtcttagagctaaaaaggatcttagatatcatctagtccaactctttattttataaattagaaaccaaggtttggctgggcatggtggctcaagcctgtaatcccagcactttgggaggccgaggcgggtggatcacctgaggtcaggagttcgagacgagcctgaccaatatggtgaaacctcgtctctactaaaaatacaaaaattagccaagcatggtggcaggtgcctgtagtctcagctactcgggagctaagacgaaagaattgcttgaacccgggaggcaggggttgcagtgagccgagatcgggccactgcactccagcctgggcaacagagtgaaactccatctcaaaaaaaaaaaaaaaaaaaaaaaaaaagaaagaaaccaagatttttataggttaagtgacttgcctaaagccatacagtcgcctaatgacagagcctctaagactagactggaggactaaaattgaagttttcttattcatagatctgtgcccttatcaataccatcaccatggtctttaggtacatgaaggagcattggacaaataggatatgtagctgctctctaattccactgagaaacagcaagagactaatacacagaagggaattacagcttttctggaatttgtctctttattattttttggacggagttcatttccattccctcacagcaatgtactgggatctcttgtagtagaagtaacatcagggagaagatgaatatatagggaaaggacaatgggaccggggagaccctagcaatccatgtgagacctctagtgagccccaaacaagtagtcatttggagaataatagcttaaaggtgtcttgaattctccagtgatcctaaaacctcatctatgaaaggagaaaaagagtctttatttcagctcataaaggaattggataaaagtgagagctttatgaattggttgaagaagtagcaggtctcaaacatcttagtcggaaataaaaatttgtgaggacaaagacactgatgtaggaaatcactgtctagagtttgaagaaaattgttccataaaatatacagtggatgtaaggtaatatacagtgcatgtctacagcaatatattatttaataaagcatgtgatttaaataggtatttaaaatgtacagttttgagtgactaatgaattaaatataacaataataaaattaaattcataaaatatgaaaactaaaaagcagaatcaaacatactaaaaaagaattttcaagttaagagatacctcatctggaaaaatgtaataagacaaatggtaaaccgtttcctaaagtatgtatttctcctgaaagagtcaaaagactaccttcactcccatttttctgagttaacaaaatagaggcataaaatcaaatttcttgaggactgtagtaatgaagatctaggactgctgttattgctttagaaccgaattaagaagaattgatggacagtgaaagaataaaaacagattcgataaaagatggcaggcggaaaaaaatgggaaaacatctaatatttttagtcagactcatggcagaagcaagttcaaagacttcggttggtatcgaggactattttatgaacccagtaaattgtaattgttgttgaggtttccaattcaaagttaaatttaagttagactctagtgcacaatggatgagagactgtgaaggtatcgtaatcactcaatatcctctctcctctctcttccacgttgacccaatgtattgtcatttatatttcatgcaaaatactacagaaggtgcttccaagcactcgtattcttttgactggcacaaatgtttccagaaaacagtatctttctgttgttaggtgacaaatactgagtgttatgtatcaagaatgaacaactaagccctacgagtcgaggactgctgctttctgccttttggaaacatgtagtattcattcacccaaaacagttgtgtacatataactgcggaaatcttctatctttgacggaagaagaaatgtgagaaaacccctaaataaaagaaattgttctcgcaaagattgactcccactatcaataaaattatctggagcttttggttctattgtgaaaaatccgccccctctgtcacaaaacacaccatatatcctgcattaaataaacttttcttaaaagtcgttccccattgcatcagcaaatttacaatggtaattttagaataagttttttatccaagcttcctcaggaaaaaaaagacacaggtattgtaggccaggctaatgtcgcattttaaaaataaactcacttgtgaatatacaggttagtcacaataaatgctcttttaaaaatgtgatacttccaacttacttgatatagtagggcactttgtttggcgagatggctctctcccagggaccctggacagacgctgaaaagaagggaggaaaaaaagaaaggcaaggaggtcaaattcatcgcaaacaggaaagacaacattaatctccagaattacaattttacactgatattggtctgtttgctcagctgcccatgaagacaggatggattaacctgctgttctgaaatttctgtcctaatctaagcgaaactgaactcattcaggcacaaagataaatgcgaagaaaaaaaaaacccacaaacatttccactgctaaacctatagaacagataagaaactgaatgagtagactgacggggtttcttgtatgtgtctcccttgagtgcttttttttataatacttcctgttgctggttctcaatattttttactatttgactgactggattttattatttcagtagctgaaatatccctctgtgatatatttacattctaagttattgaagctaaagtaatatgcttatcactctgatatggttgtttttatctttattggtttaaagagaatccaaattcacttaccaaatagatgcttaatttggtgcctcaaaatgtcagctgaccagtgtgatcttattagaaaaggtgaccaaaagtgagggaatgtctactgatatcagagcgtaataagacttttgttatgagtgatgaatcctatacgtgaaatttcatttcacatactaggaatttgttttattatgacttcactgtgtattggtcaaatgaatgatctttgcattgtttttttttttttcaggcttaagttgtaggatttcttccctaaagctgaacctctacaaatatattttatatactgtttgatctgatggttttttttctttctttaagacaaaataatcttgttgaggaggcactataacatttcctcaacaatataatcttcctcctgaatatagttttaagacactggagctttaagaaacacagaatattatcagaaacagaaataaaagacgcattcttattaatatctagcaactttatgtgtctatactttttcccctgaattttcattctgctaataatttgaagcacagctgatgctgaccattatttcctcctatgaaaaactcccttttaaattagtctcacagtaaattcactccgcagtgtattgagatgtaagaaaacgtcaaagctaatatatcctcgactacactgtataatatgaaagaacagcttctaataaaagttaacttcacccactgccagacaatttaagcgtaatgaaactccagcttctttgttttatatagagtaatagagggatcaaatcacccaacctttaaccagacatgctgttttgtaccttggagatatgtcatttaaacgatataggaaatggatttgtatttggccggtaattatgctttttcattttggcagacggaaatttttaatacagagaaaaaagacatttagctgctgttttgaagtagtctctgactttccatttctttctgtccttctttctctattcctttcttttcccttcctcctgccttccctgcttccctttccatctttgcctttctcattctcttcccaactcttctcttgtccttttttcttctgtaggatgcagctctcctgtccaaataagttcacagagtaaataagatctgatttaaaaacatgggctaaggccaggcgtggtggctcacgcctgtaatcccaacactttgggaggctgaggcaggcagatcatctgagttcaggagttcaagaccagcctggccaacatgaggaaacgctatctctactaaaaataccaaaaaaaaaaaaaaaaaaaaagccgggcatggtggcaggtgcctgtaatcccagctactcgggagactgaggcaggaaaatcacttgaacccaggaggcaaaggatgcagtgagctgaaatcgcaccactgcactccagcctgggcgacaagagcaaaactccaactgaaaaacaaacaaacaaacaaacaaaccatgggctagacttcctgacctatctggtcagagtctgttgttatggaaatattaaaaagctagccctctatagcaggaaacatggtggagagccagaaattatagctcctggctgctcagtgtaccttcttcttaaaataccagcatcataaaaggaagaagagaactccagagagctcttggtccagccctcactggctgtgaatgccaagcctgtgaatacctaaactgagaaaagaatggctattctttccttaaaggtatctatgggctgaggcctcacaatttctcttattatacctttctagtttttttttttttttatcattctagtggtccagaaattctttctaatttggaggatgctagaccatcctctgatagcagaagaatcactttggatttcctacactattcttaggcgtctctcagaaagaagtgtgctggagagggctgctggctgcctggcctggcttaggggctttcggcctgaaagaaacaacctctaagcagcgagagacagaggaaaattggcgttgcctggctgagctaatgggaagacctacgtagggtatctagagttgactttttatgtttacattaaaaggggaaaattttcaattaaatgtcagagaagttatcagaatatgcttgaactaaatagctgaaaatatttttaaagaattttaaaaatattataaattctagatcaatatgaaatttcaagcttttgtaattgcagttcttaagtgttcatttattttccttaaaaaagctttttgtcttatgtgtagccatcaaataggtccaatggtgagattcagtgtattttttttctgaaagatgtttttcccctttgattcacagtttataaattcacctaagcaactgctttgcagtcattgtttgaaaccttacaattttatgctcaaaaatgtccttgacacaataaaaaaaaaaaaaaaaaggaaaataacaacagcctcccctcattccttccctgccccatcataatcacatacacacacactggaactacttgctttagaaataacacacaattggatgatagttctacggaattgggttcagtgctccttctcaagagattcttaagggttgtcgacaatttcatttggggctgccagatgattctggtcttccatctattcaaaagttgatcaaatatgtggcagtgctcacaagtgtgccacagaattttttcatttcttgtagcagtactgatgccaacaacagctgtttcttatctcagtgtaccagtggaagcttgtcattcttcataaagctagcctacgtaatagacacacacatcttttatgcctgatgtgtccatttttagtagcccatcaaaagcaaatttatcggcaaatagtttctatatgacaccgggttgtcctttggtattttcttatacagatgtgcttataaccactacgtgtaattccagggcagctttgtgattcagattcttgaatgtacaaatcaaccattatcatacggcaccagcatcatggggtattgtccactgaatttagatagcaaactacacatgcatttatttattgcaaaaccaacctctgaatttccttttgtgttacagacacagtatgttattaagagcaagaaagggtagcaattctatcttcaaatgcttttccttccttgaggtgacaggattcaatattgtgcccaaggtagttttgaaaatcacaagcacaggccacattatttaggggaagttgttatttcagccgtttttaaatgcatgatgaacagaatgttccaagtgatgcaccctggtgttaagtcatattttaatcaacataggggcctaaccagaaaattaaaaagaatgctaatgttattttaagacatgccaaaagagcactttctggaattccaacacaaataccttcattcatctctctacttttctcatacttggtggatttggagtttgataacataggtgggtcaaaaaagtggggacagtttagataaataaccgatacagcaatcactggaggtaaaatagaaaactcacctctggggttgaacaaaaggcattagggaggatctactagacttgttttgtcttttccagaatgtcatataaatacagtatgtaaccttttgatactggtttatttcactcagcataatgcataatccatattgctgtatcaacgatttgtttcttttcattgctaagtagtatgccattatatgggtgtactacagcttagttatccattcacctgttcaaagacattaggttgcttttagcatttggcaatcatgaataaagctggtatcaacatttgtgtacaggtgtttgcataagcataagttttcatttctctaagatgaatgcttaagagtgggcttgtagggttacaacagatttttcattgctaaaaaattcccacttatggatgtaccatgatttattgaataaattccctctttgggaacatataagttgtctccagtttttcactgttctaagtaaggccacagtgaacatctttgtagataaatctttgcacatattttagttacttttttaaagcaaaattcctagaagtatatttacttgattaaaggctatgaatgttttaaaaacattttacataaattacacttatggcagcagaagcctctctttattgatataagtgtaaagagaaaaatcaattttctgcaggtcaatagtatttagttggcataattctcaaagcaagttagatatactgcttgatacagtagattatttgggaacattcctctcacactctcctcttcccctgatagactgtaaaactcagagtttagaaaggcactcaggatgttggctttctatttcaaagcccaatccagcatcttgagagggagctggatatagcagaaaatgtccagagtacagattcagaagaactggatttgagtcctgactcccctatcacttcatgatcttaagctagtctttttcctgcctaagccttattttccttatattccaatgggaataatgatatctccctcaccaaaatgttgtcaggataaaatgaggaaatcaatatgaaattgctttgtaaaatgttaatcaccacacaaataatgtttgtaatcacatagctatgatgtgttgtctgaatgatggttaattgtggaaccaattctttctctctcacctgggcagcatttatctgcagccttgaatccactcctaactactgttaatgtgccacatgtagtataaagtatggcagagagaaatgcctttgaatagtatctaactgcctgggcttatggtacttctttctacatctctgtcttcctagaccaatgacatctatacaacagatctttcattcttagctagaccatttatccaccattcatcagcatgaatgataaacagattagtctatattttatgcagtgaaaatcagaggcccatagactgattagcatttggcaatcatgaataaagctggtatcaacatttgtgtacaggtatttgcatcagcataagtttggttcttttcactgaaatgcaagtgaaaggacaagaccataagtactagaatcatagcagatgctatgagaatggctggactctttaaggaaggaagatcgtacaaagagaactgcatgtatacaccacattttcatacaatggaataccattcagcattaaaaaaaagaaggttcctaccattggtgacaatgtggatgggccttgcagacatgctcagtgaaataagccagtcatagaaggataaatgctgtatgactccacttttatgaagtgtctgaaatagtcaacctcatagaagcagtaaatagaaaagtggttgccagaagacagggcaggggaaacgagaaattgttattcaatgagtataaagtttcacttatgcaagatgagtaagttctagagatctgctgtacaacatagtgcctatagttaacaatactgtgtagtgcacttaaaacttaaggggattaagagggtccacctcggccgggcgcggtggctcacccctgtaatcccagcactttgggaggccaaggtgagcagatcacgaggtcaagagatcgagaccatcctggccgatgtggtgaaaccccatctctactaaaaatacaaaaattagctgggcgaggtggcgcgcacctatagtcccagctactcgggaggctgaggcaggagaatcgcttgaacctgggaggtggaggttgcagtcagctgagatcgtgccactgcactccagcctggcgacagagcaagattccatctcaaaaaaaaaaaaaaaaaaaaaaaaaaaaaagagggtccatctcatgttgtgttcttgccatgcacagacacacacaaaagcaaagggacacaaaacttttgtaggtaatgaatatgttcgttatctttagtttgactgtggcaatagtatcttgggtgtatacatatgtccaaacttaccaaattacatatattaaatatgcatatttttgcatataattataccccaagaaagctataaaagtacaaaaaaaaaaaaagatgagtacagtggaggaaaacaaaagggaatgtaccctggcaaatgcccccaaatggcggtggcagtagaactgctgtcaaagaaaaataatacagaagctagaataaagtgggatgaaacacaagaacagcctagctggtgaagtataagcaattcttgagcctgacagactaagggtgtagaagaagaagatgtatttgatcccacgatcactggtgacctcaaaagggcaatttcacactagtgatcagaggctgaaggagggagtagacggaggggaagcaagcatttgagaagttgtgtataaaaagaggaaaacagaaatggaaaggggcaacatctgattgttggtcatccctctcttgtgctctgtaacccagcctattcagttcacttcattactgaatttgcttagggtttctttataacgttaaattatatgcaaaatgtatttctatcgttttcatttcctaaagtcataatcaggattataatacagtatttaagctttcatgtagttattagtgttgaatatatatgtatatatgtgtaatttttcccattccaatttttttctgtatgatttctattttcttttgatgtgacgcatatagttcctgtagcaagagtaagttttctgtcatttaaatgaaaggccaagttaaatttaacacttttcaaaacgttaaattaaaataaggatagtgctttatatgtctatatcgtatatcaaaagtaaagattcaatgaaaactttaagatcacttactaaactttcaaagatgggcagactttccataaagatttcaacagcagagacagatgggctacattccagagaggaaggtcacaagagtgatgaatgagacctctaatgtctgccatagctgtgaaaatctttatggctaactaaaattcctaacgaataacaacctgtaaatattatatgagctgtcagacagataatgctgagctctgagaccattgcacatggtgaacagaataccacaccatgggatttgtcagtagattgccaagtcatttagagtatcaggctcacatttgatctgggaagtcaagagttcatactaaaattcttggcaaggtgactgagttgcagagataaaactatatctaatatccagtgctgatggctgcacagtcacacaaagtctaatagccaaagttgggcggcattactcatgaaaaaaaaaaagaaaaaaaagctgcttctaaccgacttatagaaaacttcaaaaacatcacggtgattattagaagagtaagaaagcaatcaagcttcctaaggtcagatataggaagatagatacctacataaatagagccatgaataatttatgctcaaggaattttcgagtaaattcgaacataattggctgactgcattaccagggaactttcctccaggtaatggtggttacagtctttgggccatctgggttaagtcaggttactaacaagtcaatgcaatatcgccaggtgcctttactgtctctgcagatgtacttttaaaagacgacaggcagtccacaccatttgctgaacgctctctgtgtgaaaggtattgtattaggcaccagggaaatttcaaggaaagtaaaatttgaaacctgagacagtagggagcaactcagatattaaaaaccaaatgatcatagatgggatgtacatccattagaaagcgagaagagtgagaaagaactagcaattaacgcaaaaagagtataggagagattgaatttggggcccatttttcactcagttgtgaaagaactaaacatgtataccttagccatggcctcatggtgagcgcagtgtgcttcctagctccttgaccttggcttgcttgaccatgtgacttgctttagcagatatgatgtgaacagaggcttgtcacactggcaatctgccatgagaacatgccccaggttgcttctgatcctttagtctggggctcacaacccaacacatttagaaaccatctaaactgaactcacagcctagaggcgaacccaggcatgcttcagtatgaagtagagctttccagtcaagttttatccagatcacccgaattacagttgacctgtagacccataagcatgagaacagaagctttatattcttgtatagtagttatattgtggcattattgtggatacagctgacagagagaggagtagagagagaaggggagaggggaaacagtatcataaagattaaagaataaaaaatatcctccagccaaagtctctcccatttgttactagccactgcctctactaacatgcaaagattaatggggattatcatcctctttggtctgtgcagttgagacgtgtgggttgctattcactggtgtctggaaccccttttctaaggctgataatccataatagttacaagtatgaacttgaatatgttagtaaattgttctagtctcagttttctcttctgtgaaatggagacaataacagtccttattttaaaggttggtgtgaggattaaacgggttaatctatgcaaaatgcttcctctgtgttaagagcacagagcgctcgatactttttaaaaattccaactcctacgtttataattattttcatcattaatgtagctagttatcaggatatttatctcattcacgaacttactgccaatgtgaggaatcccagggtaaccaggaaagtgacagagactttccatggttctagagttaaactgactgttaaccaccaaagcatgggaccagggaactagttaaggaaataatctttcttcctctttttctagccattttctgactctttaaaaaatgttacgcggttctcagagtaataaaacatgaacggagacaaatcttcctcttggcattctgatgctgatgtttactatgaaaatcaactgtgttttatcattatatactatattagtattgcttcagaattcaaaataaatagctaaatatttttagaaataaataaaacattcttgtttaatttcaattgttggttctgatttttaaactaaatttttacataaccaagcttactattttttttcctatttaaattggtgtgggtgattcatgttaatggaattctctgacctgaagttatgtgctgtcttgtttaagacataagccttgctgcccccgccttttttttttttttttttttttttttgcctgaagataacaaggttgtcatgagcttttgtgttgggttccaggaataactgaagatgcagttcaaaactgaatcttcctctaatagatgtatctgctccagatctcctggaccaagtcttttgaattactttctttcccttgatagctggtctaggtcgaattctataacatgaactccttcacttttcacctcctgagaataaatcccttctgtccctaactcacaccataaatgagctcatttcattccattcctcttcgattttttttttccacagacatttcctgctcagactttttctttccctatcaaattgccctcatgttgactaatccttcaattattctctctcgtctgcctatttctatctcattaaaacattagtgctctctaaaacctatatttatattcattatacatacgtaagaaatcccttttctgaacagaagggcggtaaggagactacacacgaaactggaaagggagatattcatctttttttttttttttggatacagagtcttgctccgtcacccaggctggagcgcaatggcgcgatctcggctcactgcaacctccgcctcctgggttcaagcaattctcctgcctcagcctcccaagtagctgggattacaggtgcctgtcaccatgcccagctaacttttgtatttttcagtagagacggggtttcaccatgttggtcaggctggtcttgaactcctgacctcaggtgatccacccaccttggcctcccaaagtgctgggatcacaggcgtgagccaccgcgcccggcccgagatattcatcttatcagaatggctaagtagaagggagaaactgatttttcatcactgaatgcatcttgtgactcttgctaggtgagatcagggaccaagcaattataaacattctttgctaagttcctatcaaaaggaataccctctactttggatttgcatgtagcctcagggacaatatgcgttaatactcaactagatagaacatctcctttctctcactgtggaatggattcctcccttccattctactcccattgcacccactatttactaccactgtaggaggtcattttttataggtctgtcttttgtgattggtatttaaatgtcccaaggcaataattctctttttatcttcatatttcaggtgactcgtttttgttaataaatataggaatgaatgaatgaatactacaggcacagtaagtaacaatgctacaggcaccatgtcacttcttagctcagaattctatgacttcccttctcacaaagcatatatgccaaaggcttttaacgatagccaaccatagttgataagacccttcctcgtctggcccttggtcactcactgacctcctatcattcaccatctttcttccttggcttcagtcatactggcttccttgctattaatatttctcaaaccctctaagcatgctccatcttggatcctttacttttactgtttcctccacctggaacactttgtcccccaatatctgactggtgtacttcctcacatctctactgaaatgtcaccattcctgaccactccactaaaagggtccccttctcccatcctctagcccctttagcctgctttattctttgtttttaaatcaaacttatcatgacctgattgtccatcttctcttgttaaaatgtaagctccacaataaataaactttgttttatttactgccgtttccccagttcctagatcagagtttgatttacattggtcattcaacagacatttgttgagtaacaaagtgaatcaattcttaactgactgaagataaagtgaagttcattaactctttctggacattagactaagcaccaggctaagttctttcattttattagactgggaacaatcttttaagtgcccagttattcattcaatcaaggcatatcctgcatctaatatgcaagatgttgtgttagatgcaaaattatttttaataaaaaagtaatgcaggccctatgcccttaaagtgctcacactccaacatatttcctttcaagatctatgttactgaccatcttacgttctaactcttgcctgtcatgggcatgtatgctgctgagcttaaggtttaaggtaagagattcatgtaattttatgctgtccccaaagtccttacctattaatggagatcatgaggttggacaccttaaataataataatcactacttatcctgaacaaaataatcaacctcattatgaaagcaagagtaaatcaaattacccagtgactgtaatgggcctattataatacctttttcttagatgcttctaaatgcctgtcaatttcattgccccctcacagattggcttcctccaggaagccaactctaaggcaatgattagagagcaggatagacaactgtggaagggaagtgaaagaaacaggaatagaaatagggagaagtcaaggtgaatgcagacccagtgacagtctcattcaaccccatgggagctcttgagctagaatgttaatgttctcctgagttgggccaaaatggccaggtcattattcccctacactgatcaggaagagctgcccctgtaaggggtatgatcttgggtgaggcagctgatgcaattcctgaagattgtctgctgaggacactccctttcatcgagagactaaagggtccctaaggatgcagaaaagcaacttcaaataattcctcaggcataggtcactgtatttagtgttccacatgactttcattaccacaaattgtgcaggcattggtataaaggagtgattctcaactaggggcaatttcacccaacaggggacatcagacagacaatgtctggagacatttttggttgtcacagctaagggaggggagtgctactggcatgtagtgagtagaggccagagataatgcacaggacagcccccaataatttttgcccacagaggtgtgatcccaccatttctgttgcgcaaagctttgtattctaggacagatgacaaaatgctaccccaggccaaactcacaaatgccttcattttctgagtagtgtaaaaatacacttttcagagccagcattccactaattatctggccccaaatgccaatagtgcccaggtcaagaaagcctagtttacagtctggcctgtggcctgtgagatggcattacccttagatggataataaataactaatccaatcagatgctttgtcttggagagcttgaatgtaatacacagagataaacagagatgacagatgggtggggaagtttaaaaagtcggataacaaaggaagaaaatggaagtcataagaaagtagaaactataagtagaaggtgttaggtggagagaagagagaagatatgatactgtaatagtctgaagtctatggcagcaaatgcatatacagaaagaagcaaacatgtttcgtggtgtctgttgttccatgttattcttttctttctttctttttttttttttttgagatggagtctcgccctgttgcctaggctggtgtgcaatggtgtgatcttggctcactgcaacctccgtctcctgggttcaagcgattctcctgcctcagcctcctgagtagctgggattacaggtgtgcgccaccatgcctggctaattttttgtgtctttagtagagacagggtttcaccatgttggccaggttggtctccaactcctgacctcgtgatccgcccgcctcagcctcccaaagtgctgggattataggtgtgagccaccgcgcccggcccatgttattcttcatgcctctctgtatcctgaaaatgttccttatcacctaagcctatccctgtcccttacagccttaaggagacatagcacataacagagcagtacctgcagtcgcctgaaatcaagatgatttttactgcagatatctgaaagtctatttaaaaatctagaatggtttttaaaccaggaacagtttatgtaagtctactaaagaacaaaatgccttttgtcctcacttcaaagttctcaccagaaagtactttgtaatcccaaactggttgtgttctgaaaatggaaaacatccaaatggaaaaacgaaagtaatgattcttgcccacagggatgtgatcccactatttctgttgtgcaaagctttgtattttggacagatgacaaaatgctaccccaggccaaattcacaaatgccttcattttctgggtagtgtaaaaatacacccttcagagccagcattccaccaaaatagtgcccatgttataaaactgattcagaactctggtgctggtctcttggccctagctcctcatgaggcccagaagaatctgtcacaatgaggaagatgaaataagaaagaaacagacatttgtctcatctcttccatgccaccgggctaatttccatgtaagtccgtgacgaaggagtggtggttagtgatccagctaaatgcgcccattcagctctaaagccagattatgcatggggtatgatagcagcttcataaagtctaggagaggttaatactattgttgttccactcagatcccttttactgagctggttcacccagccgcagttgttgtgagtgttggttgctaaggcctcattggtcctttcaccagaaatcctcccttggccaaatgggaactgctttgctatctcctactccccagaaatccacagccaatgactaattcacacgggaaaataaaagcccagccctggctgggcgcggtggctcacgcctgtaatcccagcacttttggagaccgaggcaggcggatcaggagatcaggagttcgagaccagcctggccaacctagtgaaaccccgtctctagtaaaaatacaaaaaaaaaaaaaaaaaaaaaaatccaggcgcggtagtcccagctactcgggaggctgaggcaggagaatagcttgaacctgggaggcggaggttgcagtgagccaagatcacgccattgcactccagtttgggtgacagaacaagactccatctcaaaacaaacaaacaaaaagcccaggccccttatctcaaagtagggacaatttgttctccagagctccctgtgggatcaagctgaagtgagtctcttccttcccacttaactccttgaccagcatccttcttactttatcctgcttccctcactccctttcacctgaacaaattacttctacaagaagccccatctatctaaatagggctctacttctagggattttacctaaggctagggtgagcaactatcttggtttgcctgggactacagagatttcctggaaaatgggaattccagtgctaaatccgggaaagtcccagacaaaccaggatgagtggtcactctgcaacgcacataaatatttggatcctgagcatccttcctgctaagtttatgaagattctttgcctacagggacttgagtgatccaaataacatagataaattagtcatttctgggaaaccatctatgcacaaaaaaaaaaaaaaaaaaaaaacaaagtgccccaatttgtagtatttgccaatttccatggagtaaatcttcccactatgcctgatttcaagctaccaaaggtaggcttaataactagctcacaattcctgtatattttacaattggctctcttgagccattgtaagccagccccagcacagaaattcccatagcagaaacaaaaacgttctgtttcctcatgtgttcaaattgatgggatatatagggccaacgatgcaaaatctggttgctaatgatactgtaaagcaaataaatctgagagcttattggggagtatacatttgagctaaaggagaaaagggccatgacaacacattttaagaagagaatataattattactgctgtagctgctttttatgggcattggaaaggctgtctttgaatttataggggcattatcagcatcactggtaggtcacatggcatttgtcccaaattcctaacacttgggacaacatgtgactgctgaagaaactggctcaaatcatttcaccctgagattttacttgaaagagaattttagcctgcaaatcatctcacattggacctgcaaaattctttctgacttttatcatgatggcttattttgatgtttttatttttttgagatgcagtttcactcttgttgcccaggctggagtgcaatggcgcaatctcggctcactgcaacctctgcctcctgggttcaagtgattctcctgcctcagcctctcgagtagctgggattacagatgcatgccaccacgcccagctaattttgtatttttagtagagacagggtttctccatgttggtcaggctggtcttgaactcctgacctcaggtgatctgcccgcctcggcctcccaaagtgctgggattactggcgtgagccaccgcacccggcctcatgatggcttatttaagccaatctgaagctttaaattattgccccactcatatttcaaattgtctgtcccctgaggacactggtagcataggttggagcactgttaagtgaaatgtcagcaattattagatgtgcttaaaggtttcccctattttttaaaattaagtgtgtatgtgtagtggggaatgtccaggatgaaagcttggcaactctcaagatagaaacaaactgctaggccctatgtatcaaggagaaactgtaaaagcttgagtcactttgacaagagagaaaaagacttaaccagggatatgattaaggcagttaagattgtaaagcctgcaagaaataatggatcagttatttctttttacagtgtctcataatctgagaaggtcactcaatgaaacagcttttaaattcagaataaatagtaaaaaggaaatttgtctttcagagtcccattgccactgcaagaggtcactggttaaaagctggagtataaaatgttacctttattgttttttttccattacaaaggtagtacatgctattaccagaaaatttgtaaaagtaaaaagaaagaaatgatgcaataactgtttgtcttttggtatctttttattttccatttttcctttatgtgtacatttctgttatttttattttattttgtaatatagttgtgatcatgctgtaattttgaagtcagccttttcccttaatgtattacatggtacagtcgactttgataaaaacgaccatataaagttatgaatgctattagtctttgctgagaagcaacagaaaaggtcacattatttattgagtgtctactatgtgatagccactatgctaaatctcatgcctctgtgtattatcaatgtcaagagtgaatttacctcttcttcttttgggtataagacataattcattctgtaaatatttactgaacatctaccaagtaccacataccacattaggtactgtagaatataactgtcaacaagactaatactatcctgacattttagagattaaggtctatctttttgattatttatcactcgttagttatacaaacaactattgagccgttctaatgtgcaaaacactggactttcagattagatccttggaaatcatcttcagaaaggagaggaactacttatactgaccattaaatgcaagagaatgaatgaaactttcatgactagtttgactctaacaggcatgcattaagttatactatcaagctgatagtaataatgatactaatgctaaagctaatagcaaacacttgaatagcacttactatgttccaggcactactctaagggttttacaaatattaactgtttgatcttcactgtaaccctatgaaataatacagccatatttcaccgaattcaatatcccattggtcgtatggtgcattctgatttcagaactgttgaaacgtgggtggaaaagtgtgtcttacaattgaccaaatatgttactattatccctattttaaagatgaagaataaagagaaagaaaaaagcataaagtgtctgagtcaatatttgaacccagtcagtttcattttacagcttttactcttaaccgctatcgataccattttgataaggcagtttttagcccagaggtgttgagagaaaaatttaggttatgtaaatcaacttaggatggccaaacgaagaggaatatacgagagaataatcgttggcaatagcagatagactagacagttattggcctgggcatttcttcttaacgggtaaggcagtgtgatgtgtggcttggatgtccagaaactgggttccagtcccagtattataactatctttgtgaccttggttatgtcatttgatcgttctgcacctatttcattatctgtaaaataaggaaagggctcgaatgattcaatgtttctcaaactatttcgactgcaacccacagaagaaaaacgttttacactgtgatctggcgtgcgcgcgtgcgtgcgcgcgcgcacacacacacacacacacacacacacacgcatgtacacacatatctaacaaattaaccaccgccaaaacaacacttaaccttgcttaggtaatgcactctgatattttctaatctgttccattccattccattccataccagtcaaaaattgttggttgtaagtcattaaactgattttaggatttgctaatgagccacacctcagagtttggaaactactggtatagatactttctaagcttatctccagttaggaaactccacagcacaagagggctcctgggtgggagtggggctgggaacttcagtaaagagagggacttgacccttttgcctcataaatactcattttctttttaattggatcacgtttctacaacctttagcagaaattttttgtcattaaagcatctggcaaataccacattaaggcaaagattcactgtgatccatggcataaagtttagtgtgaaattaactggtgtgcctgaaaaaggcttccacagtcacctaaaactggagaactatagactccttatcctcttagagtctcagtgtataataaaaattccaagaattctaacaagaaataaacttgcttatctttgaaacctagtgtttttccaatcttattaatcagtactatttttttcaagggacagttatcaaaacctaatataacattaatgttttaaagaacctggcttggaaaatattcttttaagggacctctggaacttgtaaaatattaagaaaaccatggattctttttactgttatagaatgatttctccctttacccaaatatatagtgatctttcttggtgagaaaagtagaatttagaacagaagaccagagaattgaaataatggtcaggaaaaatctttaaattctttttttgagacagagtctctctctatcacccaggctggactgcagtggcatgatctcagctcactgcaacctccacctccagggttcaagccattctcctgcctcagcctcctaagcagctgggattacaggcgagtgccaccacgcccagctaatttttgtatttttagtacagatgggggtttcaccaggttggccaggctggtcttgaactcctgacctcaagtgatctgcccacctcagcctcccaaagtgatgggattacaggtgtgagccaccacgcccaacaaatctttaaactcttcaaaagaaaaggacaattttcagactactatgccaaccaatgaatactttagtactttcttaatcacagacatatgaagagactgacaatatacctaccaattatacatatataactataaattagtatataatttaaataatttaaatgataattttattgtaaattatatacatatttgaagtcacactattagaatttctcctttttcttggtttaagttgtagaagtcaattaggagtagcagtgtattaaaactagaagtaaggacaagttagtgtctatcagcggagaagggtcatatttcacaatgcttttctcttctcattttctcttagatctaagataaaagaaaaaatttctttaacatgtagagattgggccaccaggaagaaacagtgaattcttttttttagtaaaaggctgcctctgtcttctgataaacaacagacagctggtaatgtaatttccaaataatttccaaaggggagtgtgtgtgtgtgtgtgtgtgtgtgtgtgtgtgtgtgagagagagagagagagagagtgcacacacgtgcgagacagagagagagagagaataagataaacagagacagtaagcatgtttacgctggcgggtgcaattagtagttcctccttatttttcttttctttgtaatttctaagctttaggagccaccctattattatttatagtaacctgaaagcacattactaaacatgtatcaactcaggcctgtctaaaaaaaagtatcaattcaaattcatttaatatgaccttagaggaatatttaaaacatatttttattcattggtggggggaagctgcttttatagtagcaaatacgtgacttcagagatgtcctgcttcaaatatggtgattttttttttttttttaaatttagggtcagggtcttgctctgtcacacagattggagtgcgggggggggtggattatggatcactgcagccttgacctcttgggctcaagtgatcctcctgcctcagtttcccaaagaattgggattataggcatgagccacaccatgcctagctcaaatacggtttggatggcacacccaatttctggtgcaattttctagaggtaagtttggcaatacacttgaaaaggcttacgaatgtaaacattctttaacatgacaattccacctttaggcatttatcctgtagaaagaatctgagatatttgtaaaggtataaaaaggatattagccataatgctcgatataataaagattgtgaaataatctttatattgagcaatttagaattgtgttggtaaatttggtacagccacagaagagagtattagccagtcattagaaaaattactctgaagaagaatatttaaacacacgaaaatattggaaagatagttttaagggaaaaaagcagctcataaaactgtagcatgtttttatctgcgcatggtttaaaagaaaagagagaggccgggcgtggtggctcatgcctgtaatctcaacactttgggaggcctcagtgggtggattacttgaggccacaagttcgagaccagcctggccaacatagtgaaaccccgtctctactaaaaatacaaaaaattagccaagcgtggtggcgtattcctgtaatcccagctactcgggaggctgagtcatgagaatcgctagaacccaggacgggggaggttgcagtgagctgagattgcactctgtctcaaaaaacaaaaaaataaaaaaataaaagatagaaccttgatacacacacacacacacacacgcaaccacaagagaaatacagaaagtatataaaccaaatttctgatagtgattatctctgagtcataggattatggatactttttcttttcttgtttgtactgtgggctttccaaatttttcttgatgtgtatagagtacctttgtaattttaaaaagtacaatgtaaagaaacaatccatccttagtctcaccgtcctatttcttaaatatcccttaaaccaagttggtattttctttatacctgcaagcaaagcttttaagcgtatattgatattccacatgggcatccaagagactgatgacttccggggctggctccattcaggcaggtagatcagtctctttatgaatacctgtgtctaacaggcctgacctttctggaagtgggcactgatgtgatatggtttgaaaggtgtgagaatgctccccttggcccctcaaagttccttcctcacagctcagagcttatggccgatgttctaccacctcaggcttatggattttcacactaataaaatgcaaataacccaggagaagtacacattaaactttacctatcacttgggttaaatgagtatatcattttctgaaaataggttttaatgggtaagacatgggaattcagagggggagtcagggagaagaaaatatgaatgaatatacctggtgtctgaggagtaattaatattcataatagtactattttttatttatggtttatgagtcgcttaggagtatgttatcacatttaatctcaattaaatcgaatagaatggctgtcaccaaggcaagttaagtagaccagagatttggaaagatgcagaagacgaaatctgtagcctttatcatttttctagagccgttcctaaaagccacgatcccactcatttagataaactgctttaacttatccctttttcttggcaactccaaagcattgtgaaactgtgtccaaataactagaccacatgcggataataaagttagagccagtccagaaaataagatacttcttcttaatctattatcgatgtatgacaaaaacacaggaccaacaccttccaggaaattttgttcaaaaagacaacagccaactggagacacacatgacaacatctactcaaatactttaaagtatttgtgagcgtggatctttttattaacccgtggagaatggaaaagaaaggaaatgatcagaaaatggcaatgaaagaatatggcagaagaatggagatcatacagaattacttcctctctataaaatatataaattaagtaaaattacagtgcgatgcttaaaaacacagactctggagccaacttcttgagtttcaatcctggctccctcatctactagctgtatgaatgtgtgcctcagtttcttcatcattgaaatgggtataataatggtacctaccttaagggattgaagggattgctataaggattaaactagttaaaatctgtaacatttctaggcacaaagtaattgcgttaaaatgatggataaaccctcatatatactcatatatgaccacaaggaaatacatcagaatgctaacagatgttaactccatgtggtaaagtatggctttttaaataccaaaaaactcaacacatatacttttataatcaaataaaaagtggtataaattaacattaatcagaggaaaacaggtgcttgccaatttaatatgcaatattgtataaataggattttctaatacttaaactttcagttaaccaaggttatttctcttagtattaattataaaaacataattaataaaatagcaaaaccagtaaataaaaagaatggctagaggtcaagaacaaaaggagaatacaaggctcacgaatgtaatcctagcactttgggaggccaaggcgagtggatcacttgaggtcaggagctcgagaccagcctgaccaatgtggtgaagcctcgtctctactaaaaaaatacaaaaattatctgggcctggtggtgtacacctgtagtcccagctactcgggaggctgaggcaggagaatagtttgaacccgggaggcggaggttgcagtgagccaagatcacgccactgcactcacagcctgggtgacagaatgaggctccctctcaaaaaaaaaaaaaaaaaaaaaaaaaaaaaaaaaaaggaaggatgcaaacagttagggaaaggaaatgcccataggctgaggtttcaacttggaggcatagtatttatttattattgatatataatattttacatatttatgaggtaatgtgatattttactggcatagaatgcataatgatcaagtcagggtatttgaggcatccattactttgagtatttgtcatttgtctatgtattgggaacaattcaagccctttcttcttggtactttgaaatatacaacacatcgttgttaactacagtcactctattctgctgtcaaatgatataacgtagtccttctatctaactggatgtttgtacccattaaccaccctctctttatctccccctctacccacacacctttcccagccactagtatctatcattctattctatgtttattatcaatttttttagctcccacaagagtaagaacatgcgatttttgtctttctgtgccagggttatttcacttaacataatgacctccagttccatccatgttgctgtgaatgacatggtttcattcttgcagtgtttcattgtgtacagataccacatattctttatccattcatctgttgatatacacttaggttgatttcacatctttgctgttttaaacagtgctgtgataagcatgcaagtgcaggtacccttttgatatactgatttcttagctttgggatggataaccagtagtgggattgccagatggtaaggtagttctatttacagtttgttgagaatcttcatactgttactaatttactgttacattttcatcaacactgtaaaagagttccctttcttcacattctcaccagaatctgttattttttgtcttttgaataatagccattctaattggggtaagacgatatatcatgtggtcttgatttgcatttccctggtgattagtgatgttgagcattttttcatatacctgttggccatttgtatgccttcttttgagaattgtcactcatttcataaggcagggatcatttaatgaattatttaaagaattatagagtcacagtaacatatattggatgatcatattataattacatgatatcataattattagctttatgaactgaactgataggcagaaattaaaaactcaaaagtatgtttttgcttcagcagcccatatactaacattggaataatgatacagagaatactagcatggctcctgagcaaagtgttccacatttttcaaaaagactcaaaaatattaatatggttaacatttgagaatatagtgcaggaaacaattatgcattagctgaagactggacaaaatgatccaattggccttcctcttcctaaccttctcaacttatcaaccaagttatatttcaggatgatttatgcttctactgcatctgataaaagattactataattcaactcttaattcttttgttttttcaactgttattcttattaatcaagatgcaataaagttaagtgataaaagctgaaaatgacttactggaaagaaagtgctgagatgctggaccaaagtccctgtgggcttcatgcagctgcctgactcggtcctcgacggccacctgggaggaaaaggagagaaatgatgttctctcattctatataatgaggaacaattaaaacaatgtatcctttctgataagatactttgagtctccaagactgagaacactaaagcaacatttcataactctagttttaatattcacttaccgtatatagtattccagactcgtttttatcaatccaaggccaaacacaaaggatttcctctctcgacaatgttaaaatgagattttggtttttttttacagtcaactcattggcagccacaaatgaactactgcttcaattagtaccataaaaaaatacaaatctttactttcacaaaaacattagggagggtgacatttggtataggtgactacagaatctcagaaatgacatgtcttgtctttaagtcttaggctattgtttttgacaaatttttaaagaagcaatattgattaatagataataaatcattgagtgatatttaattattgataattattaattaaccagtggttgattaatatttaattatgggctgggcacagtgactcatgcctgtaatcccagcactttgggaggccaagttggctggatcacttgaggtcataagttcgaggccagcctggccaacatggtgaaaacccgtctctactagaaatacaaaaattagtcaggtgtggtggcgcatgcctgtagtcccagctcctagggaggctgaggcaggagggaggctgcagtgagcagagatcacgccactgtactccagcctgggtgacagagtgaaactccacctcaaagaaaaaaatattaagtatcaaagaagtacaggcaaggcttaaatttgggataaaatagggtgggtagtaagataaaactaattttcggaattcagttttcagtggacttggaaattattaagaaatatacctttagggggcatgcagtgaaaactgccattcttttcttcctattaggtttttctataatatattgacacagtgtgctgtcaacttagtgagttctattcttggtggggaagaaaggaataattttacgggtgacatgctatacttacttatttggcattttgccaatccaatataagtggtggctccaggcatcctagctctctaactctggattttgatttagttgtgaacagtccatgctaaactaggggttgatcagagcttgcacagagcaatcagaactcagggggtagttcccgtggtgtgcagaattcccgagaggtaaaaatcgatgttaatctcatcagaaaagtggctcaggtagcctggtctcaaaccaactctggccttccaatatcaattaagtgcctagtgtatatccagaacaatctcattttttcactctctccctagacttgcccatttttgcttggcccaaatacgtggataaccaagtggggttcccctacaatgcaggatttactttattttatatacacaaaagcatgagggacatatcaaacctaccttcccaaccttatgaccctgcactcccaaactctacctgctaagcccaccaaaactacctgcctgtcctgcactattccatccaatataactcttgtgcgtggcttcttcatgctgctccttctctcggcaatgctcttaccccacttctctcccagatcaatgctgttagtgtttatatgtttacttcctcatctcccaggttagaattaatggcttcctcagcattctaacagtatatggtttatacctgaagcacttctatcatataattcattttagttatatggacatgagtgtgtcttgcaatagattggaaacttcttgatagcagggaccattttttgtttacctttctcttcgaatgtctccaaccctttctgcaggaggcacatagtatatggtagcaaatatttgtttaatgactagttgaccaaacaaatggatgagtaaatgagtaaatgtggtacgtgtgtgtgtgtgtgtgtgtgtgtgtgtgtgtgtgtgtgtgagagagagagagagagagagagagagaagagaagagaagcgatgcggaacaaacaagtatgcctactgacactgagtgcactgactgcaggtctgtaatggttaattctatgtgtcaagttgactggactatggggtgcccaggtaaaccactatttctgggtgtgtctgtgagggtgttttgcagacaagattagcatttggttcagtggattcagtagattgccctccccaatgtgggcgggcatcatcctgtcagttgaggtcctaaacagaacaaaaaggcatgttccttttttccctgcaggcctgcttgagctgggatgtcagtcttctcctgcacttgcactgggatttacatcatcaactcccctggttctcaggccttcagactgggactgaaatcacactaccaattttcctggctctctagcttgcagatagcaggtcatgggacttcttagtctccaactgcatgagataatacttaattttatatattcacacacacatagacatacatatatacacacacacacacacacacatatacatacatacatacatatgtatattgttgcttctatttctctggagaaccttgactaatcaatgtccctgggtaaattattcttaactttccttatcagtaaaatgtggaaaataatataacttatagggttttgtgggaattaaataagatgatacaatgtaaagcatttagcctagtttctgtcacgtggtaattgctcaataaatgttaccagctactgttcttgctactattatggttaataaaaggagaggaataggccaggcatggtgactcacacctgtaatcccagcactttgggaggccgaggcaggcggatcacttgaggtcaggagttcgagaccggtctggccaacatgatgaaacgcagtctctactaaaaatacaaaaattagcttggtgtggtggtgggcatctgtaatcccagctactcgggaagctgagacaggagaatcacttgaatctgagaggtggaggttgcagtgcgccgagatcgtgtcactacactccagcctaggtaacagaacaagactccatctcaaaaaaaaaaaaaaaaaaagcaaaaaaggagagcaatagactataatgtgcagggcaccacatacaatacaaaaatggctaatgtttattaagcaatatgtggcatgacaatatgaattatgttatttcatcttcacagtaactctgcaataggagttaatattattccccccgacttcattgacataaaaactgaggcatgagaggttaaaaaaaaaaaacttgcctaagcttcagtagttagtaaattggcagagctaggattcaaactcattcagtctgggtcttgctcttaactgctatcctgaagattaaagttgaaaaaaagtattttataaatatttaataagtaattggctttttaatttctttaatcagtttattgaatgcagaccaattctagtgtgcatatcgatgaaactgcagttgttcaacgtattttatggcccaatgcaaggtcaattcctggtcttgaagaatgtgataccataagattatagagaaaggttgtgggaaaacgcgtgcaaataaatgttgggcatatgtcattatttctaaatttagaatgggtcatttcatgaataaatcaatctagagataaatgtgagtgtttgggggtagagaggagaagatgaagatgccatatgggagtggacactgatcagaaatctttgcacatactgagaaagaaatcccaaggggaagatgtagatggtaaaggattatgactgtgccataggccactttctctagtaagaatgttagtttcatagggactgagccgatgcagcatcaaagttcattctagactcccaatcttctctctgaagaattttgccttcttatacaaggagcgctccagtggtagtttccagtgtacattcaatattgtcaagattttaaaatgagatcaaagtgaatttccatcttcataactcaaacttaagagaaggtatgacagcgagaagaattaagcataaaatatttctttccacaaattatcactggagaaaggttttgtgtggattgaatgcacaactggctaaataaagaaacaaatttatgaatgagaaaaacttgaaagcaaccaaagtcctcgaaagctttagcttgggacttaggaacaaagcactttattctttgagcaattatgcaaggaaatgaaatttgataatctattaaacgagagcctccatgcattagatctttctaactggctgtatgttaaatcaatataccgtggtatatacaaaacaggaagcaaaagccagaaatgatatacctgtgtcttatgttctggcacaatcagttctttccttggtggtttattcattttataagtatttgttaatattgaaagagataggcaaaaaacaaatgctatagtccctgatctctgcaagtgtaaaggtttggaggtaagaagtagtgacaagctgaagaaaggcttggggctgcagaacagtggtgttgaggacgacagtgagatacaattagttagtcatgttgaaagccgatgatgcaaagcaaggcgtcccagactctgaggctcaagatttaccctgcaggcaaagagaaccactgaaaatttctgtgacatgactcactattttagaggaaagttagggtttgggaagatcagtatagtgtaaaacagattcgaaagggcacctgagactgagatcagaaagaggctgttgtaacttactagacttgggttgatatgcattagaattaaggctgtattgtattcaatgtaaaagaaggtacatatgagaaggtattttgaaaggaggaagaactatccaatttggtgttggagattaatatctgaagaagcaaataaactcttggatttcgagtaaggaagactgggagaatgaagatattgctggtggcaatatgaaaatcagaaaaggaagaaatagcatatgtatgtatgaattcatttggaacataatgaatttgtcctaacagtgaaacatttaactggagatgtcatgtatagccagttagagatgaacaatttgtctcagcaattaaagaaaggaaagggaagtgagactaaaaggggtaagagtgagctttggaaggtgagccaagaaagaagagataaaggagtttaaatagaatgatttaaacagccaggaggaacccaatctcttctgaattaatagggcatgtctctgtttccttttataaaagtaatacaaatataacatctttttggaagcatacatcctgtttcaactattagatcatagatcacgaaagcttagaactggaagaaaccttgattgatacacgagggtctattcttcagaactatcccagatgggcagaaaactgccatctggtccatgagaactcataatctaggttgcagcaattcttcagtaaaagcatctcaggaaaaaaaggtccttttttatatgttccatgaggacagggacacatctttccctgctaaatcctcagtgagtagcacagtacctggcatataataggtgctaaattaatattagttgaatgaattaatgtactgtttattcacggatctttactattaacaactatattttgaatgaatcatttctttttcaagatccctgacacaagcttttgaaaaacttccctccctcccttcttcctttccttcttttcttccttcctccttttcttcctttcttccatttttgatgatgaaagtaaaaaaaagaaaagaagaaaaccatttagattcaattttgcctataatactagatttaaaaatgtaaaacggcaatttataaaacaaccctgaagtccaaatctcctccacatttgttttactctagtttttaaataatcatatttaagatttgagagttatgagggctatatattattctccttggtcttctcatttcagatgagttctgtagacagtatactgtttgcagagaccttcctttcttagcttcagtaagaaatatcactacattcattcaaaagatattgactagaatgtaagtttattgtccacaaagacagagatcttatctgtcttgttaagaatttatcacaatgcctagtacatagaagatgatcaagaaatactgaatggatgaatgaatgaaaggctttttgagttcctcttatttgtcaggcactgagataagtatgaatacggtagacttgaaagcgtaattctgggtataatgaatgagcaccaaatcatccaactaaattacgatacgacacacactcttaattccaagctgtgactgtttcccaaagctcagtccattcctctgtgtattgtgaaagataagctttatttcattttttcttcaacattgcttttaaataagccaaaagaataaaagaaagaaagaaaaaggaccgataacaacatcatggctcttagaaattatttcaaataaatttatctaaatgtaaatgttggttctttaactttgttttagattctcaagggcttccactttgtcttttgacctttctgttaattactctactttgagttttatcttcactagaagtttaggagagacaggcattacctccccatgtggaaatacactgctaggcaatgtggtttcttcctagtgtccaagctacatcttactgattactacatacataaatcatgtttactccagtctagagaaaatatgtaactaggaacgtatgttttgattttctggttctcagtttgtctagaccctagataaatatccatgggaatgcaagaaacagacatgacacttacacaaatgagcctattaaaacaaaaacaaaagcaaaagacagaaactcttgtgctgtgatgctagtaaataaaccacacatatgcacacaaatgactctccagtctattcacgagtttttgtcctgaagtttttcagtttgtacagtttctgtgtgcatgtgtctgtgttgggggaggaacttcctcgttcattcttactcccaaatcctcacaagtaacactcataaatacgtgcccaaacattatccgggaaacgctcctgagactgattacagtttcagttaaaatccttttaactaatggtaatccctttcagttaaaatccattattattctaattctgattcttttgagttgtaactgaaaaaataataaaaaaaaaaaaagtctgagataagttctggtcttgatttcaaactctcctgggcctcccagagtgctgggattacaggcatgagccacctctaccggccatcttctggaatgaagttttgtgataggtatagctctgcggcaaaacaacctgggcttgttgaatgcaaagattaactgaattgtctttcctttgagtttatttctgtgttttcctgacattagggcacttaggagttaaacagtgtttcttgcgtttgacttcaggatagatcacgggaaacaactagtgctaacatggcactcactctgagtaggagcataattcttaatagattttgtgtgacttatggcattgatactaatgccgtgccatctgagaccatccttaatctaccttttaaggttcctgcatcacagctttttttccttccattttatatttctgtgctgacttctttcttaatctgactcctttttttattccctcctttttctgtcctttctcctccagccctccccctttattatgttctatacaacctaccagaagagtacacagactctgctgaggcaaacagtgcctcaaatgaaggggctgtgcatgcttgcaagacaagcgaggcaggatatgaataggactcctagcctagtgccagcccaacgcttctccaagaacattcttcctctaattctgatgaactctgccatcaaactggaaggcaagagagaacaaaacagcaagctctttgtccgttgttaagcctttaatctttcacctcaccgatttctaaaatgcactttggatgtttgtttattggttttcttgcttatgcaactgcctcattctgtgataatggagtcaggttatatcaacattaaattgacttcatagacccaagtaccttaagggtatcattcattttaatttagaaaagcagcaatcaacctcctatcctgtttcatttgtcaaaatctttagttttaattacatctacagacttatgaaaattgtgacaggaagagaagagatcataggaagcatttcttctgcctttttttttttttttttttttggtctcagagagaaaagaggaaagttgaattactttgcctggaaggtgatgtaacttgatacagattttatcttaaaaaataggttcccttttaaaagttttcctaatgtatctcatgatttgcaacaggaactaaagtcaagtggctctcaccttacaacatcattacattaaatcatttacattccagccttagctatttattcttgagctttatttataccacatttggaagatatcgttctcacagaaattttctgaggccattggagcattcctttctaggggcattttggcccataagtagcataatgttcacatggtaattacataattatgcctcctggtatttgaacacaggagtatttccaaggaacaaaagtggcaatttgaaataatcatcagtgagataccatagaactggtattgtccgaaaaaaaaaaaaaagacggcatatattaggaaattcatattaacgaatgactgaaacaggtagataaatgcaaaaagataaagcactggaaatcaaacattttcatctcagtggcagaagcttttatattttgggtaacaatatacttgtagattttcagtttgttctactaaacacttctttaataaaggctggaagggggaatttgctgaagtctgcaacaacccttaaccgaggaaatcaaccctccttaaatcccgtaccatccttgcagcatttccaaagcttcctgaccttgactcccttcacagtcaatttgaccaccactcaaggaagcttgtccgccagaagaccctgtttccacttcccggctctcctcctctggcaagtgactgaaaagcgcctttcttttctctcactgatgcagaactgacaaaccagtatcaagccgttctttacaaatcaataaaccggaagatctcatctactgtacttccaaatcctacaacattctgtcttctctcttcttcgcatatcataagccacaagttatttacttcacgcttcttagtaaaggacaggggatggagcaatgtgcttccattgtttctctgtgtagatgtgtgagaaccagaattaaaactctgccatggactcacagtctctacggtctctctccctctgtcttctttgcacacttctgacctagccctcctcttctctccccctgcctccctcttccctcattccccctcaccccacccccaaggctgtttgtaagctccccaaatgctcataagactttcctgaactatttcagatattttcacttcaactctaaactaaaactattttgtttttccaaatgtggctttacatagtgcagaaaactacagggaaaacatccaaagtacaatgtgatcttttataggagaaacaaaagattgaatttctaggtcatcatggaagtaggtacacttccctgggcgataatctgaggtactttataagcttctttctttcacgaaagcaagaaatcctaaaatccatcaagatacgtgcactgtgcctcaactctctttttaatcctcaagtgaaatcaacacagtacagtgtaataaaaatgcatatagccccaggctttgtgccttagcaaagagagaaaaaataagcttcctgacttcatatgtctactgtgaataatcagtcactgcgtttttgggattttgctttataatcttaacgtatagcagtgaactccatgtttgtggtgtgacaagaataaaggattctttttctttctttaaaacaggttgttcccatattttccataagagagacatgtgtcggcttaaaagaaatgaaactacaatggtgtgagggaggaatctcctgattgttagcgtatattttctgcattttacctgaaattgtcaacgaagtgtaggtaaagttaaggcggggccctaggctgttcaataacgtggctaacatttggtttgagggccttctcagttctgttcccaaatagtcagcctttctttcccaactgcttgtccttagctgattagtaaataaccctaggaagataaatgattgttcataacaggcttccagtaccacagctgtgagtatttgcattttaagtgcaactttaaataattaagccattaattactcaaatacttattgagtgtttataaggcactttgctaggagaggaagcagaaaaaataaaaataaataagaaaacaaggggatggtctttagtgaatttgtagatttgatatttacaaataagcataataaagtattatgggaaagattttaatgtagtgcagtcattccccaatttgacagtgtatcacaactatttgagaacttttcaaaaaaatacagattcttagctcgtctaaataatttctgatttagttaatttgaggctgaggcttgagaatctttactttctttaagtctccacagatagttctgatgtacagcctggtatacatccatcagtgtagtggaaatgccacgaattttatgactcaggaagacctgagttggagtcccttactagctatttaaccagcatcttatctaacagcctgtgaaccttagtttctttatgtgttaatagaaataccacataacaacactaccaacaatgacagtaataatagcaaacatttatagagcatttactatatcccaagtgctatttcaagagcattataggtatatttcatttatgtctttcttatcagaaggtaaatttgatgagggcaggactcaatctattttattcattactgtacccccaggacccaggtcagtgcctgtctcatagtaggtacctaactaactacttgaaagaatgaacatcactatgaggaaagtacaccatagtgaccattttacagatgaggaaatggaggcacagagaatgagatgttgtaatgtgcacagttggagagaccactttctggcactcggtatgtactcatttttctgataactgcaaattgctagaacaagcctaaacagctatgggggttacagagtatctggatgaaattaatgaaggaggttgctttgaaactgggccttcacaattgggtaagcttttgatgggcaaaaacagaagaaacactctgggtgacaagagtagaatgagcaatttttttttttttggcactagtaaaggcccggatatgaaggataaacagaaaaagagttgaataatacaaggctagaaatgtagcttggagtcaaaccagagctgtacttgactgtcaggtttaagaatagagacttcatttagttgttcatgggaaggcattcaaatatttttttaataattattttaaaattgtatttctttcaaatgcattcacatgataataaaattcaagaaaaacaaaaaaagttatttaaaaatcaagtctctctttcaccatgtctctctagccattttcttccccattccctgatggcaagtatttccatactctacattaattttttaagtaagaaaaatattacgttggtgcaaatgtgatcgcagtttttgccattgaaggtaatggtaaaaccacaattacttatgtaccaacctaaatatcattgtcagaatggtgttttaggatgaatgaaagcatggagaaagcgaagagaggataagctgccagaaacgaaaacaagagatgttctgtgttaaatgtaacaatatcagaaagtagactcaaggaagcctcagactctcaccctaggtgaggaggagatggataaaaatcagaaggaaccactggtttgttgcagcatagtttgatgtaatagcaaatcagtaaatcatggacggttgaacaaagactggaggaatgatgggaaaattatgaaaggtgtggcagtgaattctccttaaagcccctcttatcattcattctcattgttagcaagatccctaccatagctggggcaaaaacaatgtatttaactaaaaatgagctaaggcgtgtaaagcgtttaacagcatctgttataaggtgagcactgagtaaatggtaactgttacttatttgtattaaaaggtggggctgggcatggtggtgcaagcctgtaatctctcacagtgacctgggaggctgaagtgggaggatcacttgaacccaggagttcaagaccagcctgggcaacatagtgagaccctgtctcttaaaaaaaaataacacaaacaaaaaacatggtgtcagagcagaatacaatggggtgagtttgacagacccatctttaggggaagttccatatctagcttcccttttttatagtaaatacttgagctggtttgttgagggtaacccatacgattttaatcatttaccaggacttaaatctggaaagtatgacagttgggttcaagaatcaatgattccaccagcattttcaagggctgctatgtacactgtactgtatgttcatcgtgtggtggatggcaaagatgggacatgaaaaatttcttttctcaagaaccttgtgtcttgctgggagatgactgcagctgagacgaattagagacttttgaactgatagtctctgtgttatgaccaataagggcaatatgtatttttggaagtgagacagcagtgaggccaggagcaatctgggaggcatcagaaaagaggtgacacagaacatcattgtcctaggtcagactcagtatcagcagcttagcatctcatgtccatgaggagtattttttgaacaggtattttgcatgccatttgtgatataatcttaatgattcagagattcctgagatttcaaacagtatcacttatagtgtcaatctttcctttattttagtaagcaacaagtcatcattctcttaccatcttttttttttttttttttttgagacgtcctgctctgttgcccagtctggagtgcagtggcatgatctcagctcattgcaacccctgcctcccaggttcaagcaattctcctgcctcagcctcccgagtacccgggattacaggcatgcgccaacccacccggctaatttttgtattttttagaagagatggggtttcaccctgttggccaggctggtctccatcctcctatcttttaaccatttcacggttgtttgcaaagaactttcaaaatacagtgattagaatgattcgttttcttgtcttttccttactgtattgaaattgattttttatggttaggtgaatatagatgattaaatataaaagcattgaatgattttgtgttgtttagataaaaactgtgaattttgcatgagtaaagggctagtatcgctattgttcctacttgaaaatgatttcagtgcactgatatcaaactttttctagacttttccaaagtaatcggaaatgctccaaattttgaaactttttgagtactgacatgacgtcacaagtggaaaatttcacacctgacctcatgtgacaggtcacagtcaaaacttttgtgtttcacgcacaaaagtatttaaaatattgtataaaatttccttcagggtatgtgtataaggtatatacgaaatataaatgaatttcatgtttaggcttgggtcccatcccaagatatctcatgaggaatatgcaaatattccaaaatccacaaaaataaaaaatccaaaacacttctggtcccaagcattttggataaggaatacttaacttgttttccgatctaacctggccctaacattcaactttgtaatatataatgaagaaataaaacaacagagtaaggccgggtgcggtggctcaggcctgtaatcccagcacttcgggaggccgaggctggtggatcacgaggtcaggagatcgagaccatcctggctaacacggtgaaaccccgtctctagtaaaaacacaaaaaaattaaattagccgggcatggtggcgggcacctgtagtcccagctgctcgggaggttgaggcaggagaatggcgtgaaccccggaggcggagcttgcagtgagccgagatcgtgccactgcactccagcctgggtgacagagtgagacaccgtctcaaaaaacaaaaacaaaaacaaacaaacaaacaacagagtaaacttccagagtaaacaaatctatacctcagggatatttaaatatcagaaataaactcatacttttgacttaccatcttcataaggcaatgcatatgctgaacacagatgattcttatctgttcaccaaactaaggtctttaaggactttaactactaagaatatttacgttaattcaagttaatatttgttttaaaaaacagaatcttttaaatattcaggatatagatgtttcaccaattcaatctaccctttctggtcaaaagttaaataaattggatggaatctcaagtattcataactacatataagaacaaaaactatcaagaatgtatcaacaaaaggtttccgtggcctctttcagtacacataagacatgtatctttttttttttttttttttttttttttgagacagagtcttgctctgtcaccaggctggagtgcagtggcgccatctcggctcactgcaacttccgcttcccgggttcaagcgattctcctgcctcggcctccccagtagctgggactacaggcatgcaccaccacgcctggctaatttttgtatttttagtagagatgagtttcaccatgttgcccaggatggtcttgatctcctgatctcgtgatccgcccacctcggcctcccaaagtactgggattacaggcgtgagccaccgtgcccggccaagacatgtatctttatagagcaaggtttctcaacttcagcattattgacattttggcctgggcaattttttgttgtgctatctatcccacgaattatagagaatgcctagcagcatccacaacttctacccactagatgccagtagcacctcctcaccagttgggacaactgaaaatgtctccagaaattgccatgtcccctgggggacagacttgctcttggttgagaaccactagtgtacagtaaactttcaccctctacttcatatacacagatattgatgtttgagataagagagtcctattctatgtctataactggttgaggaaggagaagttaacagtcccgagttatatacagactattgtcagatctgcccaattcagtattcctctaattggcagtctttgctctggcattccttgttgtgctgacacagagtctagaagatctgcattgtgatctgatggcttcccttgttcaattctgcttccacccctatttcttcacaggtgttattctgcaataaatctgccctggcatctgcttcttggaggactcaacctgcaacaataatcaatcaatcaattccacgattccattcccctagcctaggtgggcatgtgacccaatttgggccataaagagtcaagcccatacttgaccagtctttaagctctcgggtcagagtagctctctcttttctgcagggtatgttgagggtgttaagaggatggcaggtgggcctgcagcaatagtctgaaagccaccactgtcaccaacacccttttgtttcttaactaatctgagttgagttttctgtcacttacagccaagagtccagcctaatatactttataataaaggggaaactacagaaacatttaagaaaattagcattgatcctaaaagttgttacaaattacctcatcacaataactattcagagcaacgtatttaagttgctcaagaaccacaaagcacattgcctttttaaatttaaagagacttcataaaaatgtgggacagagcagaatggtacccattattatagaatgattttaccaactgcggcattaattctccaaagatttcccccagtctcattatgaagaaataatagacatagaatactaggctgggtgcggtggctcacgcatgtaatcccagcactttgggaggccgaggcgggcagatcacgagattaggagatcgaggccatcctggctaacggtgaaaccccgtctgtactaaaaatacaaaaaattagccaggcgtggtggcgggcgcctgtaatcccagctactcaggaggctgaggcaggagaatcacttgaacccgggaggtggaggttgcagtgagccgagatcacaccactgcactccagcctgggcgacagagcgagaccccatctcaaaaaaaaaaaaaaaaaaagaatactagatattagatgccacaaggttatcaatatacactagtttcgaggctttttgaaaattttggtgcacccctatccagcatatcccgcccctctctatttcacattccctgttgctaatattaggaaaagagaacgtttacgtgagtatgctatttgatttgaaccaacctctcagggtcaataatatttcagtattttgtgtgcagcatttaagattataaagtatgcccatttcagcactccttttaaacagaaagatttagttgaaaactcaaagccacatttgtccactgaaagcttttaaaaagcttcatttgtgaaaagacacattgaccagagctgctggggatcattaatgaaagctggatcttcaaaggagattctgtgttacaaaaaggtacttggacattttggctaagctgcagaccacctgtgatttggccatttgatagagggttggttgttgacaggtcctaagagataccccctatgtctcttctttttaaaattgtattaaaagatttgtatcatgggctccctatttaaaatgaaagtctgggcagctgccccttttactccgtctagaagaaggtaccttacattttctaacatgagttttccatcaataattgtctgctatgacaccaaagtattccccacctcctggctggagagcatgttgtcttggtcatctcctctgttatgttggagacagagtgacacacgtaggtgaatggggtctaaaccaattaaatccttgtctgggtctaaaccgattaaaaaggaactcaaatctattttctctcagattgggagagtccacgaaaataaaaaagccaaacaacagaaatgctgcccagttgcacaggatgttgctattatctagcatttgcacatcaatttatgttttcaaactcattgacagtcactagttaccggcaggcactctgttaagaagtagagaactctaagctgagttttgaccatagattcccggaagtgatttacaagatcattttcaaatttgtatgaccaaaaggcattttaaatatgattttaaattgcaaagggacgaaatcatgggcttcttgtgtttctttggatgccaatcacattacttcgagagctggcataggtcgtggatgtctcaggctacgcaccactgataacacaaactatgcgggcactggagcagaaagatatgagcagaggaagagagataagtggtgcctctaagaccccagaaagtggttttgaacccttgtggatctcactggaaagggattaggagaataccacctggcagaagaccattctcttattaaggctgatccactctctctctctctcaaaaaaaaaaaaaaaaaaaaaaaaaacataaaaaaaaaaataaataaataaaaaagataaaagaaaaaaaagaaaaaaaacttaagtaggagggaaagtctagagttgacagagctgaaaggctctcaaaattttaagacttttttttttaagtgtcttaaaatattttagggactttaactttgtcttagtaaagatgataaaattaagttcactacacactcattctttttagaagcttttcacctcccttttaactgtgtgcatttaatttgtgtaataatcactgtatgtccccttcaatgtccttttgtatctttttttttagcattttagtctatttctgtctgtctgatttttttcttctattcaaagacattttctcctctattatagctttatttaatgtttcccttatgctacagcataagtgcctttttttctccatccatatctctaaattagggggtccctcttccttttctatgcagcagtctgtcttcagcatgatgtcttcacttttctctattgtagtctcttttgtgattggccaatagcaaaatgaaacttactagaatccaatcccaaaagcactttagaaggatggaatcttatcatttactccctgaatcactatcatcagtacagttggtgtagaacggtattccattctggggctcattggataagtatgagttcaacctggcagctataaaataaccgggggaaaatcttgttcctttcctcctttatagctcggaaatttgtgagtgaccttgcttctttatttctaattatgccctatggaaaaataacgccttttttttcatttatattgtatagtgcctaagatttttgggggcctttaatgaacagcagtacaatttcattttcattttacaggatatgcaatataattttgaaaaattaaactacatgctcgaggaaggattcaacatttccggagaacctagcattttccctcagaagactaaaattagatcctgttttaatgactgtccctgcaacactgacttctatgtaatgagaatgtttccatgttcctgctgacagaccacctactattctttgctgatgtggggctgataattctgacaatcaataataataattgtataaacattaacatgtattgagtgcgtgctttgtgccaggcactgcacaaagtgctttataatgattatttcatttgatctttgtaataaccccatgagttaagaatacaaatgctctggcatatcagaattgttcacatttgatggttgactcaatatcgacttttaaaaactgtctagaaacctcccacgacacttactgcactgatggttctccatactcctccaatgacacaaagcctatcctgctttgaattcttgtattattattattcatatagggagaattcaacaaataaacaggtattctattgacaccaagaagactgacactgccgctgctctgctccactttgaggtttgtagcaaatatgtctggtgcttgcatcacatcttgtcagcccacctgtgattccagtgtcagcagtagtggacggttctgtgcaagttctaactcgtgctgtatagccagcatcccttctcaaaagggatccctgagcctttcagctttctgttctaggttcccctgacccccatgacatgggagcttcctgggtgggcaagcatagccagccacaggggttagtgctttggcagcaattctctttttcccctcccaacttctgcacagtgtttattgagcttactcatatcatatagttcacagctttgatagaaaaacttcttgtttcctttttgtatttatacttagattttctacattgttttgaatctttccgacgttgtgtgaagttcagagcagcggaaaaggcaggggtgcactggagaggatgtgtcccactcagatccaatgcttgcccatatcagatgaaaaaggaatcaattctcaaccagtgggagcaggagcaggtatacacatgctctggctttccatatttcaggctgtagctacctatatccagatttgttttcttctgtacacttctcaacagttccagagaattgctcatctttctttgtcgcttcattcttcttgttctcttattcctgcttcttagaattacttgcacccaggtccccccgcccttttttttttgagacagagtcttgctctgtcgcccaggctggagtgcagtggtgcaatctcggctcagtgcagcctctgcctcccgggttcaagagattctcctgtctcagcctcccaagtagctgggattacaggtgtgtgccaccaagcccagctaatttttgtatttttagtagagacagggtttcaccatgttggccaggctggtctggaactcctgacctcaggtgatctgcccacctcaacctcccaaagtactggtattacaggcatgagccaccatgcccggcccgaggtcccttcttgattctgtgatgaggtaacccctcactacaaagccaggtcttaggataggtctcaccatcattaaacctggactcttggagaaggcaaatgtgaataccattaaaaaccagaatctgtgatgttgacagtggaaagtctacatcactcattatttaagaccctctttgtcatcaataaatgttcatggaaattcaggcactatcttaggtcccactgctgaggccgggatttaatccagaatctgataacaagatttgttggaacttctgccttagggcaggagaaaacaataagaaagactttaaaataaggagagtcacctaatcagatctgcattttaggaggattactataggcgcattgtggaaaagggattcggaagcaagaacaatatcagggagataaattagaggctatgtagcatttgagtcaaaagatattggagtcaagggaggtgtaaataagggaatgaattaagagatggcttggggatagagctgacagaatttggcaatgcatcatgttagatttaaagataaaagtagattcagaaataataccctaatttttgacttgggcaattgggtgaagcgtagcgttcataagaacagcacaattagggagggaaaaatgttgagggtggattgggacaaaaggaggataataatgagctgctggggacatgttaagtctgaggtgtctgtgggacattcaggttgtggtggacaagaaacatagaaggtggctgggtctgaagcccaggagagaaataagtctgaccttacttcaataatcaagccagccatttcaaataattatgctagagcaattgaacatccatatgcaaaaaataaacctcaacttaaacctcatactttatataaaaatcaaatggatcacagacttaaacataaaatgtaaaactataagacatataaaacaggagagccaaaatggtgaaaccccgtctctactaaaaatacaaaaaattagctgggtgtggtggtggaggcctgtagtcccagctactcgggaggctgaggcaggagaatggcgtgaacccgggaggcggaacttgcagtgagccaagatcgggccactgcactccaagctgggcgacagagcgaggctccgtctcaaaaaaaaaaaaaaaaaagaacaggagaaaatctttgggatccagggctaggcaaagtattcttagactcaacacaaaagcatgatccataaaaggaaaaagcgataaattcaacctcgccaaaattaaaattctttttcatcccctgttaagaagatgaaaagatgagagagaaaacatttgaaaaccctatacacaagaaaggactagtatctgatacagaaagaactctcaaaaccgaactataaaaaaacttttgaattagaaaatagacaaaagacatgaacagacatttcaatgaggaggatatacatatggcaaacaagtacaggaaaagttgttcaacagcatttgccacgagggaaacgtaaattaaaagcacaatgagatattcctacacacatatcagaatggctaaaaataaaaaataatgacaacaccaaatgttggtgaagatgcagagaaactggatcactcatacattgctggtggaatataaaatagtacagacgcttcggaaaagtttggcagttttaaaactaaacattcaactaccatatgacctaacaattgcactcttcagcatttatctcagggaaataaaaacttatgttcacacaaaaacctgtacattaatgttggtagctttattcacaatagtccaaaactacagataactcagatgtcttcaaggggtgagtgattaaataaactagggtatatccaaaccatagcatacaactcacgataaaaaggaaacaagtcttgctgcatataaaaagagaaatctctagggaattatgttgagtgagtcaagtccatcccaaaatattacatactgtatggttccattcatataacattattgaaataacaaaattaaagaaatggaaaacagactagtagttgctggaagtaggaggtagggggggcagggaagtgggtgtggctataaaaggccaataggagggatctttgtagtgatgaaaatgttctgtatactgacaatattgacgtcaaaatcctggttgtgacattgaactagagttttgcaggtgtaccattagaggaaactcggtaaaaaggtatgtggagtccgtgtataatttcttacaactccatgtgaatctacaattaaaaatgctgagatctagtagttctcagtaatgtatcaatgactgaattttcatcagattagttatattgaatattaattctaaggttctgtcactatcccttttcaagaatctagaagcttagatttctttttgaagcaatataccaatagttttcttattaaaaattcagaaggcttcaatggcgaataattttttggtaataagaaaaaaaactaagaattattttttattaaaaaacaacaaaatcagctcttaagacacttacagttcagatggggaaataagatctagatatgtgaaaatgagtagtgtccggtgaaaggctcgtttctgggtggttagttcaaaggttccctggaggacgctgagcttgagctggatctgcaatcacatctggattgagggaatccttccagcactcagcaaatagcaggaaaaactgtccagacacagcaggtatcaagatttggagactttcctcatcaggagggaagcatttgttttgtttgtttggacatacaaggagacagaaagaatattgataatggatgtatttgaacccgatcttggtgacaatgttgagccaaagttgtaaacatgatgattaagaactcaggtactgaagttggactgcctggtgtgactacctcgtttctcaactgagagccactgggcaaagcacttaactcgctaagtttctgcttttgtatctaaaaatgatactactcatcagaggtacctcagaaagtagttgttagaattaagggagataacgtatgtcaagtccttagcacagtgactggcagagtctcatctggcatatattagctctgagcttaatgggggtgctggtggtgataatgacgttgtctctccaaaggttgcaaacggcttaggggcagagactatcgcttatcttagactacctgatgtctgggacactcctggcacacagcaggagttttgcgaaattaaactggcaaaagtagtgttcttgcaagattaacttgacagcaattggctgaccagatggaggaaggagagattttaggcatagagtacaagtagaaagctgctgcaatgatacaacttcactcctcatgacaagggtcagaaaaaatggttggtgtcagcgggaatgataaggaataggtaagtaatgaaagatgaattgaaggacatagttcctgggctttgactccacattttaactatgaatagattctaagcttgactgtagtgtgcaaattaggcctctttcggagagaaggcccagtatagcagaaagaacatgagttttgaagttaaacactgttctgtcccatatgtcatttgtgtgaccttaaaaaatgtatttacaaaaggcctttgacaaaattcaacaacccttcatgctaaaaactctcaataaattaggtattgatgggacatatctcaaaataataagagctatctatgacaaacccacagccaatatcatactgaatgggcaaaaactggaagcattccctctgaaaactggcacaagacagggatgccctctcttaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccatcgtctcaaccccaaatctccttaagctgataagcaacttcagcaaagtctcaggatacaaaagcaatgtgcaaaaatcacaagcattcttatacaccaataacagacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaagaaatggaagaacattccatgctcatgggtaggaagaatcaatatcgtgaaaatggccatactgcccaaggaaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacaggaagcaaaacagcatggtactggtaccaaaacagagacatagatcaatggaacagaacagagccctcagaaataatgccgcatatctacaaccatctgatctttgacaaacctgagaaaaacaagcaatggggaaaggattccctatttaataaatggtgctgggaaaactggctagccatatgtagaaagctgaaactggatcccttccttacaccttatacgaaaattaattcaagatggattaaagacttaaatgttagacctaaaaccacaaaaactctagaagaaaacctaggcattaccattcaggacataggcatgggcaaggacttcatgtctacaacaccaaaagcaatggcaacaaaagccaaaattgacaaatgggatctaattaaactaaagagcttctgcacagcaaaagaaactaccatcagagtgaacaggcaacctacaaaatgggagaaaaattttcgcaacctgctcatctgacaaagggctaatatccagaatctacaatgaactcaaacaaatgtacaagaaaaaaacaaacaaccccatcaaaaagtgggcgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcggtcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtacgtttattgtggcactattcacaacagcaaagacttggaaccaacccaaatgtccaacaatgataggctggattaagaaaatgtggcacatacgcaccatggaatactatgcagccataaaaaatgatgagttcatgtcctttgtagggacatggatgaaattggaaatcatcattctcagtaaactatcacatggacaaaagaccaaacaccgcatgttctcactcataggtgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtatacacatgtaactaacctgcacattgtgcacatgtaccctaaaacttaaagtataataaaataaataaataaataaataaaatgtatttactctttcagcatctgtagtagacaccgtggcgctccaccctggacctcctctttagggcctttgcatgcatgggccacctgctgccttattggctgctggctcacagctggggccttcattggaatgtgccctcagggaactgcctcacacagctacatcccctccctcagggagagacctagggccaatgactggctgatgcagggattaactcatttatgcctagtgttccattattgggacgctaagcttgtgggagttttttatatcctactgctcaaggtcatcgccaaggtctgacttttcacaaaacatttttgcaacctccagcataaatgggttaaagtcttcacccatttgatttactggggacaactctgaaaggccaaacctactccagagcttccctgcatgctcctgctgcagccataattgcaactgcatggtgaaccagcttttcctctgcgcagtcatgcccctttcagtttcttagaggtgtaaatcctgagagcacttcccagtatgacaataatccttctgcaagcaactctccaactgcttctgcttctgagcctagtcttggagagccttttattcctaatctgtgaaagggaaaaaaggtacacagttgttattgagagttgtgctgggaataaaacgagatcatgtgcttggcagaaaaccgtgttcaagcaatgacagctaataggtgatacttgaggacattatgctacgtgaaataagccagtccaaaaaggaacaaatactgtataattccgcttacatgatgttcctagaatagtcaaatgcatagagacggaaagtagaaagatggctgccaggggctgggggaaaggaggaaatgagaagtggtttaatgggtacagtttcagatttgcaaggtgaaaaagttctgcaagtccactacatgacaacatgaatatacttaacattactgaactatactctaaaaaatggttaaaatggtaaattttacattatgtgtttttaccacaatttgaaaagaaagaaatgatggctaccataccattgattccatttaattgattttacccacaagcaggtaccttttctggcttctcctgtattttctcatcctgttgggtgggacctatagtttcaaacatgattgaagctccctgcctcctctgacaccctggatattacgtctccgtaatctgattttttacaccaatgtttctaatctccacacatctctttagactttagattctctcatgagctgaaatcaccctggcataggctctgaggaactgcatggaagcaaacagcactattttccttccttcctctaacaaaacagatctctttaaaatcaccaccataacctttcgaaaagcacatcaaactgcatcatgatacaaaagaaattatactctgtcggtgccaggttgttgaaaataagggattgagatcaggagtctggggaagttgacagatataatgatgtgcttagatatcctgatggattttgacacagattctctgcttgggggtgagtgtaattactatttgtacagagagcagagtcaaggtcagaaaatacaggagagggacccatcaagctaaagtagaggactttaaagtggttggggagtttttgttattcagaagctcaaactggtcagcaggacaaaagaatatacagagtcagggtatgggcaggggccaatatccaatatccagaaattcctgtctagcaagaatggagaggaaatgtcagagcatgggttggaatttggaatgaagttatatgaggaaacagacaaggtacaaaacgtgaccaagaagttggaggtgccactgcaaaatttggaataaaaggggtagtgccaaggcaggtctgaggactgatcctaagccagtggttgtttcttctgtcctagttttaagcagctttcctagtgagggtggatgagggccaagagcactgggcttctccccagagtcacacaggattctgcaggttttaatgattacagcagagagagcttggtcccctggaaagcccttgcggttctaacccagcaaaatgcattgaatctgacaggccagcatttaccacctctgatgccagtgcatggggaaaaacaaattgccccatttgcaaacttagtacatatatgcagttaggagttgctctactcgttacacaaaaagattttataagtaaaaaatacttaaagtctggcactaagtttctactccctgtttgttttgattttgatacctgtactctattctaaagacttggtagtgagagtagagcgggaggtggcggggggaattgaatgcctcccaagtatttgaagggctgtctttgccaagagggtttacacttactgtgtatatttccaaagcatacatatagacagaaaggcagaggttatgggaagatcaacttcagctcaatgcaagagataacagcctaattattagggtgtttgtgaactgaacaggctgctttacaaagtgaggagttccccatcactaagttttaagcctaggccaaagtgttttctagcagaaatgtggaagaactcctgaaaggatttagactagatcttgaaggcccctttcaacctaagattttattactcaaacttgttaagatgtgattaacactagcttaaataagttaactatcgagagtcagcctaatgtaatggttaggattaccaggtctgcagccatattacctgggtttgaatcttggcttcttactagctgtgggctttgggcaaattactcaatctctctataccttagtcttcttatttgtaaactgggaattacaacagtacctatctacaagatcgttgttgtcaggcctctgagcccaagctaagccatcatatcccctgtgacctgcacgtatacatccagaaggcctgaagtaactgaaaaatcacaaaagaagtgaaaatggcctgttcctgccttaactgatgacattccaccacaaaagaagtgaaaatggccggtccttgccttaactgatgacattaccttgtgaaattcctttccctggctcatcctggctcaaaaagcttccccactgagcaccttgtgactcccactcctgcccgccagaaaaccaccccccatttgactgtaattttcctttacctacccaaatcttataaaacggccccacccctgtctccctttgctgactctttttggactcagcccgcctgcatccaggtgattaaaaagttttattgctcacacaaagcctgtttggtggtctcttcacacggacgcgcatgaaatttggtgccatcactcggatcaggggacctcccttgggagatctatcccctgtcctcctgctccttgctctgtgagaaagatccacctacgacctctggtcctcagactaaccagcccaaggaacatcacaccaattttaaatcaggtaagcggcctctttttactctctcctccaacctctcactatccctcaacctctttctcctttcaatcttggcgccccacttcaatctctcccttctcttaacttcagttcctttccttttctggtagagacaggagatgcgttttatccgtggacccaaaactccggcaccggtcacggactcggaagagtcttcccttggtatttaatcacgcggggatgcctgcctgattattcacccacatttcagaggtgtctgaccacacggggacgcctgccttggtccttcacctttagcggcaagtaccgcttttctcgggggcaagaaccccccaacccttctctccatgtctctaccccttctccgcttttctgggggacaagaaccccccaccccttctctccgtgtctctactcccttttctctgggcttgcctccttcactatgggcaaccttccaccctccattcctcctttttctcccttagcctgtgctctcaagaacttaaaacctcttcaactcacacctgacctaaaacctaaatgccttattttcttctgcgatgccacttgaccccagtacaaacttgacagtagttccaaatagccagaaaacggcactttcaatttttccatcctacaagctctaaataattcttgtcataaaataggcaaacggtctgaggtgcctgatgtccaggcattcttttacacatctgcccctccccagtctctgttcccaatgcaactccttccaaatcttccttctttccctcccacctgtcccctcagtcccaaccccaagcatcgctcagtctttctaatcttccttttctacagacccatctgacctctcccctcctcgccaggcccaattattcctcagcctctgctcctccaccctataatccttttatcacctccgctcctcacacccggtccggcttacagtttccttccatgactagccctcccccacctgcccagcaatttcctcttaaaaaggtggctggagctaaaggcatagtcaaggttaatgctcctttttctttatcccaaatcagatagcgtttaggctctttttcatcaaataaaaaaacaagcccagttcatggctcgtttggcaacaaccctgagatgctttacagccctagaccctaaaaggtcaaaaggccgtcttattctcaatatatattttattacccaatctgctcccgacattaaactccaaaaattaaattccagccctcaaaccccacaagacttaattaacctcgccttcaaggtgtacaataataaagtagaggcagccaagtagcaatgtatttctgagttgcaattccttccctccactgtgagacaaaccccagccatatctccagcacagaagaactccaaatgcctgaactgcagctgcgaggggttcctccagaatggcctcccccaggagcttgctacaagtgccagaaatctggccactgggccaaggaatgcccgcagcccgggattcctcctaagccatgtcccatctgtggaggaccccactgaaaatcggactgttcaactcacctggcagccactcccagagcccctggaactctggcccaaggctctctgactccttcccagatcttctcggtttagtggctgaagactgacgctgcccgattgcctcagaagccccctagaccatcacagatgccgatcttcaggtaactctcacagtggagggtaagtccgtccccttcttaatcaatacggaggctacccactccacattaccttcttttcaagggcctgtttcccttacctccataactgttgtaggtattgacggccaggcttctaaacctcttaaaactcccaaactctggtgccaacttagacgatactcttttaagcactcctttttagttatccccacctgcccagttccctattaggccgagacactttaactaaatgatctgcttccctgactattcctaggctagagccacacctcattgccgccttttcccccagttcaaagcctccttcacatctccccttgtatctccccaccttaacccacaagcataagacacctctactccctccttagcgaccaatcatgcaccccttaccatcccattaaaacctaatcacccttactccgctcaatgccaacatcccatcccacagcacgctttaaaaggattacagtctgttatcactcgcctgctacagcatggccttttaaagcctataaactccccttacaattcccccattttacctgtcctaaaagcagacaaggtttacaggttagttcaggatctgcaccttatcaaccaaattgttttgcctatcaaccctgtggtgccaaacccatatactctcctgtcctcaatacctccctccacaacccattattctgttctggatctcaaacatgctttcttcactattcctttgcacccttcaccccagcctctcttcactttcacttggactgaccctgacacccatcaggctcagcaaattacctgggctgtactgcctcaaggcttcacagacagcccccattacttcagtcaagcccaaatttcttcctcacctgttacctatctcggcataattctcataaaaacacacgtgctctccctgctgatcatgtctgactaatctcccaaaccccaatcccttctagaaaacaacaagttttttcctcctaggcatggttagatactttcgactttagatacctggttttgccatcctaacaaaaccattatataaactcacaaaaggaaacctagctgaccccatagatcctaaatcctttccccactcctctttccattccttgaagacagctttagagactgctcccacccgagctctccctgactcatcccaacccttttcattacacaccgctgaagtgcagggctgtgcagtcaggattcttacataaggactgggatcacgtcctgtagcctttttatccaaacaacttgaccttactgttttgcctagccctcatgtctgcgtgcggcagccgccaccaccctaatacttttagaggccctcaaaatcacaaactatgctcaactcactctctacagttctcataacttccaaaatctattttcttcctcacacctgacgcatatgctttctgctccccggctccttcagctgtactcactctttgttgagtctcccacaattaccattgttcctggcccagacttcaatccggcctcccacattattcctgataccacgcctgacccccatgactgtatctctgatccaccagacattcaaccccatttccccatatttccttctttcctgttcctcaccctgatcacacttggtttattgatggcagttccaccaggcctaatggccacacaccagcaaaggcaggctatgctatagtacaagccactagcctgcctcttagaacttctcatttcctttccatcgtggaaatctatcctcaaagaaataacttctcagtgttccatctgctattctactactcctcagggattattcaggccccctcccttccccacacatcaagttcgaggatttgcccccgcccaggactggcaaattggctttactaaacatgccccgagtcaagaaactaaaatacctcttggtctaggtagacactttcactggataggtagaggcctttcccacagggaaacataattcctcggtttggccttcccacctctatacggtcctataacagactggactttattagtcaaatcacccaagcagtttctcaggctcttagtattcagtgaactaatggtcttttaaaaacacacctcaccaagctcagccaccaacttaaaaaggactggacaatacttttaccacttgcccttctcagaattcaggcctgtcctcagaatgctacaaggtacagcccatttaagctcctgtatggacgctcctttttattaggccccagtctcattccagacaccagaccaacttagactgcaccccaaaaaacttgtcatccctcctatcttctgtctagtcatactcctattcaccagtctcaactagtcataaatgccctgctcttgtttacactgctggtttacactgtttctccaagccatcacagctgatatctcttggtgctatccccaaaccaccactcttaactcttaaagtaaataatctttgctggcaaggctatgctgaacctccttaggcactctctaattagacgtcctaggtcctcccaattcttcgtcctttaatacctgtttttctccttctcttattccgtttagtttttcaattcatacaaaaccgtatccaggccatcaccaataattctacatgacaaatgtttcttctaacaaccccacaatatcaccccttaccacaaaatcttccttcagcttaatccctcccactctaggttcccacgccacccctgatccacctcgaagcagccctgagaaacatcacccattatctctccacaccaccccgaaaattttcgccgccccaacacttcaacactattttgttttatttttcttattaatataagaagacaggaatgtcaggcctctgagcccaagctaagccatcatatcccctgtgacctacacatatacatccagatggcctgaagtaactgaaaaatcacaaaagaagtgaaatttaaatggcctgttcctgccttaactgatgacattccaccacaaaagaagtgaaaatggccggtccttgccttaactgatgacattaccttgtgaaattccttctcctggctcttcctggctcaaaagctcccccactgagcaccttgtgatccccactcctgcccaccagaggacaacccccctttgactgtaattttccttaacctacccaaatcttatagaacggccctacccctatctcccttcgctgactcttttcggactcagctcgcctgcgcccaggtgattacaaagctttattgctcacacaaagactgtttggtggtctcttcacacggacgcgagtgaaagttgtaacaattaggttggtgaatagatatgaagtacgtagataatgcttggtatgtagtagttagtattacttctgttgctgctgctactactactactattactactgatagggacaggaggcagggaaattctggacagaagagggcgggtctctggcaagggccccacccttaagcctaaaagcctggaactgtggcccaaagtgagaacttacatccctgttttcctgctcaaatgttgccttttccaaaaccacccatagcccaccctgccctccatcctgtgcctgtaaaaatcccaggctcagccggcacagaggagaagcagctggatgttggaaactatggttgtgcattggagagaagtggcttgacttccgagggacagcctggcagcatagcttcagagaggagtctgattgcggacagctggactcgaggtgaagattaccttcctgctctgtccccttttcagctccttttcctgctgagagccactttcatcagcaataaaatcccccgcatttaccatctccaattagtttgtgtgacctcattcctcctggaaaatgggcaagatctgaggtgccacaagtgcgagtacagaaggctgtcacactgaccctccactgagctgttaacacttaagccatctgcagatggcaaagataaaagggccctgtaacactccttctggggattcaagggtcgcgggcaccctcctagacactgccatggggcccacacagagttttgttcctgctggcgcccaaaagcactcaccctggctcctgtacccactcacctgtgcttcctctcccatgaggggtggaactcagtgagactgagccagtggagtctgcccctgccagcaccgaagcggctatgcagtccagttcccgcccgcgaggggatcagggtaatatcctgcttcactactactactactactactactactactactactactactactactactactttagcttcatagatatcaattcttgctttttggttgtgattttgtactctgatgaccagagaagagaacagggacctgtggaatataaattcatggtgaagtacatgttatgttatcaattcttgaaaaaccctgaaatgtagactcatttcccccatgcaggtttgttgtttttgaggaaagaaatgacagctgtgaaacaagtctaaattgtgccctaatgtctgagtgtccaacagtatgctgctgttgaagcaatagcaaagcagagacaaaacctattgtttcctctccctgtataactgaaaccatggccggttgcccttttctgtccatgatgtggaaagctctgctctcatgacctcaaaaatgggcatgtttcaccattcactcagagaagatcctattacagaaaaacaatacccagctgcaatttaactcagagctgagaaaccctctacccaatgattatgggcccacttttgtgatctacctgtgaggcaaaaagaacattctttcaacgatgtgcgtaggatgtctgtattaggaaaactgataaatggaaacgtggaggacttcaaataattctcatcaagtctgttcttaaaatggcaaacttccaaagtcccttgagaatacacaggtctcaatgagaagaaaaagcggctgataaaacattaggctttccaaaaattgcccatttctcctcaaaattcctacatgaaggttcacaaggtttaacgtacaggttgttggaagcacaaacaaatctacctcaggagagttaattcacctcaggaccaatttctcctctgctggtacatctactattcatttagcagccctgcttggataaagcccagagccatttcaacggcagtaggaagggacgtttagagagttatcatcagtcatttatgcctgcgctgttaacaactgaatcaataacatcagtgctatggagagcaccttcagagcctagttaggatgtctgcagttgtcagattagacaggcaagatgttttggaaacatatttgtttcaggaaatgtttaagtggtaagcatccacagggttctgtggccatcctgttcacaaacatggatatattaatagatttaatttggttgactaatgaagatatttattgttgctttaaaaaaaattcttataatttttgtaggtacacattaagcgtatatatttatagagcatatgagatgttttgatacaggcatgcaatgtgaaatcagcacattatgctttttatattaagagatgatgttcagagaaatgcaaatcaaaaccacaatgaggtaccatctcacaccagttagaatggctatcattcaaaagtcaggaaacaacagatgccagagaggatgtggagaaatagcacttttacactgttggtgggactgtaaactagttcaaccattgtggaagacagtgtggcaattcctcaaggatctagaactagaaataccatttgacccagccatcccattactgggtatatacccaaaggattataaatcatgctgctatgaagacacatgcacacgtatgtttattgcggcactgttcacaatagcaaagatttggaaccaacccaaatgtccatcaatgatagactggattaagaaaatgtggcacatatacaccatggaatactatgcagccataaaaaaggatgaattcatatcctttgtagggacatggatgaagctggaaaccatcattctcagcaaactatcacaaggacagaaaaccaaacattgcatgttctcactcataagtgggaattgaacaatgagaacacatggacacaggaaggagaacatcacacaccagggactgttttggggtgaggggagggaggagggatagcattaggagatatacctaatgtaaatgacgagttaatgggtgcagcacaccaacatggcacatgtatacatatgtaacaaacctgcacgttgtgcacatgtaccctagaacttaaactatagtaataataaaaaaaaaagaagagatgatgttgatgggggttggttttcctatgtctgtgtgaggctgaaaagctggtattttcagttttctgtttttcagaaaatgccttcccctttgggttctgtattatgtaatcatagcacttttaatgccttacctcatttaatttcttcatatgggagggaggtctaactctgctagtctttatgctccctggggacaggggtctaatccatctctgtgtttccagaatttaacacagtgcttggcacataatggatgctcaatattgtttactgaatcactgactgtatgatgaatgaatgaacacatgaagtaaaaacatgatttagagtcctgatctatctaatcacaaaggaactctttggtttcaatctatcaagtagttgtgactgtcataatggctttcagctgtctttagctctgcagtagtttttttaataggcttcattctagacacatatactcaggtgttcctgagctgcttccttaaggcatttcctcggtcagatctacttatggttgacatctcaccacaactaacatgaccaccttgggaatattgctcttttttgcgtaatgtttgggccaacaggttatgaagccaaacacagtgattaggactagtggacttgggggcttcctgggggagcattacaggtgacacaaaatccttggttgacattaagtacatttgtggatttgatgcttacaaatccagctgtgactcccttggcaagttcaagtcttagactctataggaagctaaaaatggtcattgttccatcaaatttggtatgatctgaaatctacagccatgctttctgtcattttttaaaaggcacattgacctcaaagagcacaatttgagaggaattcagatgaggtgaattctaacccagatatcacattaaatagctgtgtcatcttggccaagtcttaacctttttgaacttgtctagtaagggtgttagactagatgatctcatgatatgtaaattaattctttttttttttgtttgagacagagtctcgctctgtcacccaggctggagtacagtggtgcaatcttggctcactgcatcctctgcctcctgggttcatgtgactctcctgcctcagcctcccaagtagccgggactatgggcatgcaccactatgcctggctaagttttgtatttttagtagagacgcggttttgccatgttggccaggctggtcttgaactcctgacctcaggtgatccacccgccttggcctccaaaagtgctgggattacaggtgtgagccaccacacctggcctaattcttttaaatgttatataatcagcttagtcttgcctcaaggactttttatgtgttgccctgtttgggacacaattcctcatgaactttcgggtctccctccccacttctttcaggtctttcctcaaatgtcacctcctcagtggaaccttccctgatcaccttatataaaatgacaattccttccatgaacaactctctagcgtcttccttgctttatttatttcaacatgctgtcactatttaaaattgttatatgataattgtgtacttgtttatcatctttcttctttgtttttcggttttttttttttttgagatggaatcttgctcagtcacccaggctggagtgcagtggcacgatctcggctcactgcaatctccagctcccaggttcatgccattctcctgcctcagcctcccgagtagctgggactacaggtgcccaccaccaagcccggctaattttttttttgtatttttagtagagacggagtttcaccatgttagccaggacggtctcgatctcctgacctcgtgatccacccgccttggcctcccaaagtgctgagattacaggagtgagccaccacgcccggcctatcatctgtcttctttacaagaatgtaagctctcctgagggcaggggttttgtcttgtttgctgctttattatcaatacctaaaatggcgcctggcatataacagacccacaatagatattaattgaatgactaagtgaatatttaaactcctagctaaaaagtcttcagggtttcttaggtgtaatctggtttaacacaccaagttgagaatcacagaattattagataattaaagcgaaaaaagacattaagtttacctagctcaatacctcattttgaagacagaaaaagtgaaagtcaaaatggttaaatgaggccaggagcggtggctcatgcctgtaatcccagcactttaggaggccaaggtgggcggatcacctgaggtcaggagtttgagaccagcctgaccaacatggcaaaatcccgtctctactaaaaatacaaaaattagccaggcatggtggcaggcacttgtaatcccagctgcttgggaggctgaggcaggagaattgcttgaacccgtgaggtggaggttgcagtgagccaagatcacgccactgcactccagcctgggtgacagagtgagactccgtctcaaaaaacaaaacaaaacaaaaccaaaaaacatttgagaccattggaagagctgaatctcagcatcctattaggaaaagttaaacttacagaaaatttgcaaaagtagtatagaaagttcccatatacaatttgtccaacttccaacttcttttactaggaaattagtttgcctgcccaagaaatgtctgcaaggggttttatgactatttcattttgatcctctacatattgaaacttgagatgctccagctgacttattcattatcttgggggagtgtagattatttgtgcaacaggcatattcttattttaagccattttatccaacgtcatcaaatgatttaacaagagacttttaaacttctcagaatattcttccttataaataacaggaggtgccttagtttaggaatggcagacaaatgtaaagcacttgtaccattattttctcatttaataccaatggtagaaattactaatcagcctatggcactgtattgtagtcttccccaatttgctttatgctcttttacaataaaccactctaggcagctgatatcagtcaataagagcttgcttgtgagatgaacaatatttaccattccagatatagtgcagtaaggaataagataaagatgccgaaactcagattctattataatcacagattatccattgattagcttagtgagttttaaaaaatcatttctacacttctgtgccctacttcacacagttaggatgagggttaaatggaatagacacatctaaaggtgctttgtgaaatgtaaagaattatatacatgaaacctgatcttaggatattcaagaaaattgaccatagaaatgcatttctccaatatactttaagaatcctttgtttttctaccatctgtttagtttagtctgtatacatctaacttttattcccatgtccaacagaactgaagttagagtgtgagagattccttcttcagctaatggaataaatgatatagagctcagtggataaacatgtgcttgagtgccattctagagcaagccctcatgacagctgagccagagaaacatatttcagccacttccctatctcattgcttcatatctcagataatttagaagtatatgattttaaaaatcactgctttctgatcaagtatcaattaacatcctcagataatttgggagggtgtgggattcgtagccggattgtagcaaagttggaacttaaaatggaaaaaaaaaacaaaaagcccagaccgaaagccatccatcacttacacatttattcacatccttgaattctgagatgtcatattcttttgatttttgactgacttctcttctcctacctctgcttgacttctttttcttgaagtttatcaaggtttggtcctaggccatcttcccttccctctttacatgctaagtgatttccattctggatgctctaaattccattttgtatcaatatttttctcatttacgcttctagctcgggtctctcctttgagctataattgaatttgacttctgcacttggacatatcacacacatttcaaactgaacatgtctaaaactgaactgttgatcttttccaaatctgcttcctcctccatctttatcacctcagcaaacagtacaacaagttgatcaaacaaaaaaaacttgggagtcatcctcaatccctcatgcctgacatctaatccatcaccaagtcatacagattttgtctcgaaaatacatctcaaatctgttcatttctctctatttccattgccgccatcttactcccagtagtcattttctttcatcaagacaactgcaaatgcctcttacctggcctctttgcttctactcttgccacattcaatctctcatttatacagcaggtccatcagattgtatgatgttttgcaggtacatcagctcaggtgtactttcacaggtacgtcagattatattatttctctgcttacccataaaataaactctccagccttgtcctgtaccactcaccccctcagtcattagctcctagccatacttgcctccttttaggtcattgtcttgaaaatattattccattcccctccctgttcatatgactgacctaaccttcagattttagcttaaatatatccttttcagagaggccttcctagactatgaagaagttcccactattattcttccaaagtagcctattctttgtcttcataacatttctcactatttttctttttattttatttttatttttttgagacagagtcttgccctatcacccaggctggagcacagtgacgtgatctcggctcactgcaacctccgcctcttgggttccagcaattctccggcctcagcctcttaagtagctggaagtacagacagggtttcaccatgttggtcaggctggtcttgaactcctgacctcaagtgatccgcccgcctcggggtcccaaagtgctgggattacaggcatgagccactgcgcctggagcatttctcactatttttaataatatattaatgctaacatttttactggctatttgtctcactgtcttgcaaattccttggcacgtccaaaaatatttcttcctattttgtgccagacaatatgccgggtgtttggactatgaagatttataatgaaaggtccttgaactaaaaggctacacattggctgggtgcggtgactcacacctgtaatcccagcactttgggaggctgagatgggcggatcacgaggtctggagttcgagaccagcatgatcaacatggtgaaaccccatgtctcctaaaaatacaaaaattagctgggcgtggtggcacacacctgtaatcccagctactcaggaggctgaggcaggagaattgcttgaacctgggaggcggaggttgcagtgagccgagatcacgccactgcactccagcctgggggagagagtgaggctccatctcaaaaacaaaaaacaaaaagcaagcaaaaaaaacggccacacatttagtaggaaaaatcaagaaaaggtttataaatagagtggtagacactgttggttgcctcatcaacaaccattccactctcccttttttctctagtgattatctatttccacacacacaaaaaaaagtttaaaaagcactgatagtcaatttcttagtttcccttgcaggtagatgcagctacttgacctagttctggccaaagagatgttagggagacatgctgttgcttctgaaacatgacaagaactgccactcttcctttattttccattcacactgtcatgatgcaattcctggagtgtggcagccattttataaccatcgcgtgacaattccaaagaccaaagccaaaggctaaggatagcaaatgcaaagatggaaagacattggattctgaatgaaactgttgagctaataaaccaattttgggtatatctttctcttaaattcctattatgtgagaaaaataaacgatggttgcttacattttcattatatatccctttactagaagttaaagcctctataccgacacaaactgttcctgctgtgacaacaatatagccagcacaagtccccccaaaccacagatcccctgaccctggtgtcaagattgggtcttctaattctgcatctgggtactctaggaagctttgtggcttcccatttatatgactgaagcgcgaactgtgtctatatgtgtatgcacacatgcacactggagagaaaggacaaaagatcattccacaattgagacttgaaggctaaactgtaagatggctgtacgtaataaagctctaatcctctattaggctcctgaaatctaggttttatggtttagtaatgttttcattatttcaaagactcagaattctttctctctgaggcatcacaaaagcttccatagaaacagatagagaatgaatgtcacaccaagaataggaaataaagcaaagaaaaatttgcagtgaactagtcattaatgaaaggtataaagagtgcatgcaaaatgttaataaatcattaaaaggttaggaaagtttccagcaaggaagaggtctctgagccaaaaggttgaggataacaaggtacctcattcagccatattctgtcatcatctccacatatcattgttttgaaattttaatatggaaagcaggtcattcttttaaaaaactgaactgcatctaaaatcaattagatctcatgatctacatgttcacctcatcttagggcacagtatagtaaatgatcttaacttgtttaaaatattttttcttggctgggcatggtggctcatgcctgtcatcccagcactttgggaggccgaggcaggtggatcacaagatcaggagttcgagaccagcctggccaaatatggtgaaacccggtctccactaaaaatacaaaaattagccgggcatggtggcggacgcctgtagtcccagctactctggaggctgaggcaggggaattgcttaaacccaggagacagaggttgcagtgagccgagattgcgccactgcactctggcctgggcgacagagtgagactccatctcaaaaaaaaaaaaaaacaaaaaaaaaaaacaaacccaactttttcttaaaatcaaatattccataggatggtgtgatgagcattcacatatcaagagaatacatcatcatcgtcatcatcatatcaacaactagaaattattgaataccaactatacaccaggtgctccactttgcattttgcaagcattgtctcatctaatcctcagacaactctttgagcgagtgctattattactcctattgaacagataaataaatggaagcactacaaaagggagttgttagtaagtggtgaagttccaattcacaccccacacgttgactcccagactctgaaaattttcagactctaagcttaaaaatatagaaataagcaaatgaataaactagcgttcttatcagcccagaaaggagtcttcactttatgcatgttaaacactgttactgttagctaaattgctctttacaacaaggcttacaagatgatgatactatcaacattttgtatatgaggaaactgaagtcttaagataaatctagctagctatggcagagccagaacctgagctctgtttatttttattctaaagctatgtcaatatttgctaatacttggtattggtaatattacaatggctttctttttatgacacatgatatccatctcaaaaatattagattataacatttgtatgcaacttaagaaagatgaagttatttggaaaagggattgagatatgaagattgtgatataagaattgttaggtgactacagctctgatggaaaggtttatgcgcaccagaatctcagctgtagctctgttctctttggagaaacaacttgtaaaaatatgatccttgttagcaggatatctaatatccattcttgttccattgatagcatttgaaatttatttatcaaataatcacttcagtttttctaaactaccttaaaaatatttttaaaacctgaggataaagaggacacatttttaaactagtgcatttttctcttacaattaaatcgatattccagctgggtgcagtggctcgtgcctgtaatcccagcactttgggaggtcgaggtgggtggatcacctgaggtcaggagtttcggaacagcctggccaacatggtgaaactctgtctctactgaaaatacaaaaattagctgggtgtggtggcacgtgcctgtagtcccagctactcaggaggctgaggcaggagaattgcttgaacccgggagccagaggttgcagtgagctgagatcatgccattggactccagtctgggccacggagcgagactctgtctcaaaaaaaattttttaaagttgatattccatttatttttctccacttaaatacagattttttttatgatctcataaggatcacaatgaatagctaggccttagttttgcagctttagtttcattactatgagagagagagaagggtgagagagagagagagagagagagaccaagtgtggtgagaagacatatgttgtctttgtgggtccagtatttcatccttctactaactgcctggttgttgtttctgtttttgtttttcctttgaggaatcgctttccccatatttcttgtgactctagtagagctgccaatcatggtacctttttgccttcctcaattcccctaaagagttcaaagaccccataggttactcagactctgccactcaggaagctgacaaaggaagaaaataatacaaggttggaaagactttggagcttagtatttcaaagacaacacttaaaaagaagatgcatgtgttcctgcttttgagattttagaactcttatacttcatgtcctattctgagacctagttttcaaattacttcgttcatttctatgagtatcttttaaataaagagcccctaccccatcccctttgttttccctgacttgaattagccagagttagctgctggtgtttataactgaagaccggcagacactgccggttagctacttcaatacctgttgaaaaccacttctccctagccatctttttgttggtggctgtcatgtgacacagttctacacaatgatatacaagtagaagtctttcaaaaaaggtttctgggaaatttttggctttataaaaatgataagactcagatagtacaccctttttgccttctctttttcaccctgtgaaataatggtggctgctatattgcatgaggaaaagtcaataaaaaatatacagatgccagtcctgatactgttgggcccaaagcaccttatttccagacatcttaatattggagataaataaaactctatttatttaagccactgtagatagcttctgtgttttttgctgccattgcaattctaaccccagccaataaaatgggaatatgaaaaacaaacaaaaaatatgaatccttctaaacaatgaagaatttatggggttagggtttgggaggaacagaagatatagccagatgaatttaggcatatctctcaggaactgacctttgtcctttagctattactgttgattagtcttagatggcagtgaaccttgtagctgatgttaatgcaaaactggagaacattgcatcctggatataggtatattctgatactctgatacagggcccttagcttccaaagatgacaattttttttttttttttttgagacggagtctcgctctgtggcccaggctggagtgcagtggcgcgatctcggctcactgcaagctccgcctcccgggttcacgccattctcctgcctcagcctcctgagtagctgggactacaggcgcccgcaaccacgcccggctaattttttgtatttttagtagagacggggtttcaccgtgttagccaggatggtctccatctcctgacctcgtgatccgcccgcctcggcctcccaaagtgctgggattacaggcgtgagccaccgcgcccggcccaaagatgacaattatatgtgtgtacataaatatgtgtgcacttgtactgagtaaaatagagactgatctcacccatacgtcaattctacttagacaaaggaaatcccagggtttttttttttttttttttttttttgtctctccataatgtgctattaaaataaaatgctattttgtcagtgcctttttcttttgctttcaatcctggactgtaggcaagacatacagtctcctcagagattgagaaaggtcaataatagaaatgctgttttcctcctttcactaactgattaaataacgcatgggcatatgtatagctacacgtgtatttctaaggaaaatcattcaaaaactgcatgatttcctgaggtgacctccagggtgctgaaaatttagaaaacgtaacatctaatgcaatcaataaaatcaagaatctgtgttaggcattttgagagttttggagtgagtgacagtacagccaattgatatagtccccgtgaaaggcaggtaaggcatctttatgtggctctctattgatgagaaaagtcttcctaagagaataaactagatttagagtgtgtcttatgaaaactgttgtttcccccatgccttcccagttaactcatttgtataattttggggcttcagctttgatggggctcctttatttgcaacatttagattaagttaatgactgttttatcatagctaagagcactagaattaggaggtcaatggctattagcatttgattttcttgatgataccaaagagatgagtttgagggggaagaagtgtgggcttgattactcatgttttaatttcatctcagtagacaaatccaaaatgatgtctcagggatgactcagaattccagatgggatatgtgtacttttgccctttgtccagtcctttgcacactgggcatatccactgacaacacaactgtcagaggaacaagctttcaatttccagtttcaagagggaatgagatcaggcttgaatgatcatttatggtgactgaattgctttctccgacaaggaagcctcacttgttcgtggactttacggatggtgctctcaaaaattggccagttaatctctttatctgttgcatctttcctagattccattgtgtctttcgaaaatactgtaaaatttacaaatgtagcttaggcaaaatgcaaatgtgtttctgtcttaaaaagaggaaatagctatctgcaacgatatgggatggagagaaagcgaacaggaggaccgtttagaatcatgatgtaggaaacataatgcaaaattgtaaggctggtgtgggggtatggcaaggataactagtgagagatccccaacggagatgtgaaatttggagaaaagcataggaactgcacataatgcaaagtttccttctctcactttgagctcagtgaatctgggatttgttttatgaacaaagatagcaagttgctttatgatggcagtggttataacaaatgcatgaacaaagtaacgggtaaacacataaaaaagaacaattgaccttgcgtaagggagagcaaatgtaacttgacttatgtgctaagaataatgcaaagaaaaagaactgagcacttactatgtgcaacacatatagtatgtactgtgttatgtacatgaggattatacgcttcatctcatttaatcctcactacaaccctatgaaaaaagcactactgtattattttcattctactgatgaggaaactgaggcatagtacataacttgattgaggttggcaaagcagacagaatctgacagaattgcaatttaaatctagagcctctgaactaagccactaaaatggactggctcagagttgaataagaataggaatttccaggtttataagggctttccaggcatagaaagagtattttcaaaggcatgaagctgagaaagacatagcgagagggccagaggccgaagagtaaataaggttgcaagggggtagggtggggagcagggaggaaaaaattctttttgaaaaaatgtgttgtagatatgaagtctcactatgtttcccaggctggtcttgaactcctgggctcaagcaattctcctgtcttggcctctcaaagtgctaggattacaggcataagccactgtgcccagccaggaggaaggaattcagttaagaggctagatcagtgaattggagccacatcatatatattttttcttttttagagatgagatcttgctatgttgccaaggctggagggcagtggctattcacaggtacaaccacagtgcctacagcctcaaacttctgggttcaagagatcctcccacctcagcctcttcagtagttgggactataggtgtataccactgtgcctcactggagctgaaggaggatatttccctgatcccttcgtgggtgggaactggaggggagcaaactccactcactcgctggtccacccctcatggaagggggagcacaggtgagcaggtgcagcagctggggccagcatttttgagtgctggcaagagtgaacaccgtacgggccctgcagcagcctctaggggagggtgcccatgaggaagtgttacagcgcccttttagctttgccattcacagatggcttaagtgttaacagctcagtggagggtcagtgtgacagcctttttcacccacacgcatggcacccaagttcttgtccagcatccaggaggaatgaggtcacatgaacaaattgaagatggtaaatatgggggattttattgccaatgaaagtggctctcagtgggaaggggagctgaaaaggggatggagtgggaaggtaatcttcccctggagtctgaccatccacagctggactcctctccaaagctatgctgtcaaactgtccctctaaagtcaagccgcttctctttgatgtccaactgtagtttctgacatccatctgcttctcctccttctgccagctgagctctggggtttttataggcacaggttggggggtgggtggggggtaatggatggttttggaaaaggcacccttcaagagggaaaacagggatgtaagttctcactttgggccatggttccaggctttttggcttgagggtgggtcctcaatggggacctgccctcttctgcccagaatttccctgccttctgtcctttatcaaagccacatcttgacaggctatggatactgacctggagggagagaaagctgtagctatagaagatttttttaatataatggggtactaggattagatctgttgtttagcaagataactagccatagtgataaagatggataaaagtctggggacagggaggctaatcattagaaggccaaatcattaatagtcactgagaaaggactgagggaagggcagagtagttagagaggaatagctggatttgagtgtttttatttttagatataagagtcagcaaacagaatttagtgaccaaataaaaactgaagataatagagaggaagaagtaaatgtggccccaaattttctaaattgcaatgacatcattaataaagaaagtaaatgcaaggtgcaaaacaggtttgattgtgatatggtatgtaggaaacacaatcatttccattggttgggccatatctggaatattatcatcagttctggatagcttatattgaaagtgtgaaaggaaaataaatcttggggcctcaaaatcaccaaactaaagggaaaagtcaagctgggaactgcttagggcaaacctgtctcccattctattcaaagtcatccctctgctcactgagatagatgcttatctgattgcctcctttggaaaggcgaatcagatactcaaaagaatgcaaccatttatctctcacctacctgtgacctggaagcccctccttgcttcaagttgtcccacccttctggatggaacaaatgtacatcttacatatattggttgatgtctcatgtctccctaaatatatataaaaccaagctgtgccccaaacaccttgggcacatgtcgttagaacctcctgaggctgtttcatgggtgcatattctcaaccttggcaaaataaacttcctaaattaactgagaccagtctcagatatttgaagttcacaaaagggaccactgttaattcttgcagaggaagataaagacgaagatgaaagtcttgactgagggtaattatgaggaacaacagagggaacgaaaaaaatcaatataattgaatacttttacaaaagcagttatttagagtgtataccctgaactcaagttctgttacacagtgggatatataacagtgatgaaagagccaagcttttcttagcttttcgacttagcaggacaatgaaaacaatcaaaaacccaactagttcacatcagcttgaaacgaggatgcttagagaagatacgaaaattgacaacgagtattttacagatgtagagaagtgacgtttctctttggctccagtgggcaggaatagatcaatatatagagatttcaggaaagccaattttcatttattataaagactttgaaacaaccagaactgctccctgggaaaagggtgatttatcatcaatgactgtactcaaactgggtttgaatgaccaaactgacagggattttatagggtcgaatcctgccttaggaagaaaatgaatgattcttaaatccctttaaattctgagattgcatggcagaagcacgatgaagatcacactacctaaaaagagaggatctgatttcaggtcctagaagccttggttttattggcccttagtttccatatctatgatatgagtttagatgagttatttctaaggtttcctgttgctttaaaacattcaatgattttagagttgcttgatgtcgttagaaatattgaatgccagaatgtggaatatttatttaattggataagaaatagaaaaactttgttcaaaaattttaagaaacaatcactattaaagctgcacttagaggctatttatctgcaacaatgagtagacgtaaccatgtcagctaacatttattaaatcctatttcagctagtgagctaagcacctgatataaatgatctcatttaattctcataacaaccctgtaacataggtactattcacagtcagggaaaccaaaccttggagaggttaaaacatttgcccaaggttacacagtttctaagtggtagagaggattcataccctgacagctgtcaacaggaattaatgaaagttctctgtaaagggccagaaagtaaatatttctggctttgaggaacacataaatctccgttacatattcttctttgggtttcgtacaacttattaaaacaagtaaactgtttttagctcccctgctattaaaaaaaacccaggccccatgttgaatttgtactgagacctgtagtttgctgtcccctgctctgctctcttactacaacaccctactgcttccccaagactactatttactgaggacttcttatgggccagacactgcgctaaatgcttttcatgcaatatctctgtaatacaacgagcctctgggttggtttccattttatagatggaaaataggcttagagagtttcagcagcaactgaaacacaaatacaaggctagaaagtggcagagctgtgagctttgtgaatctggaaactgtgattttatccattgcagtagagaggctgagtagagtgaactgggactggggcagggagggactggaataagaaaactggtgtgtagagcatggcaacagcctagacaattatggtatggtttgaaaaacactgtagcttcataatcaactggatttgtcagtttattggatgtcaggcagggtggattaggggaaggtcactctaaggtctgagcttggcttacttagagaacagaaataaggaaatcaggtatagggctgctttgaggagataaacggatgggccgataaagcttatggtggcaagatcccttatagttttggctgcttcactaactagttgtgttatggcaggcaaaaaaattagcttctcttggcttcagtatcctaaagtacaaaacgagggtgttgaattagatggtcccttagtttacttctagtgataatgttccagttggtgaaaagcaaaggaaaattctaggaaactgccaaaagaaagagcctagaataggctttttgagggaacgatttctgaaaaagaattgaacagaagggtgctaaaaagtttattgtaattcttctgtcttactgctctcagcaaataaagatcaaacagggtatttgtgtttgcaaggtcaaagtaaactagtgtccattatcaaatggctgaatgactcttaactggctcagagaaagatcagaaaatgtataggagaaaactaatggaaagagtgattaacgtgatcgtttctggctccaaagaataaggaaacatgggaaatgaagaaatatgaagaagtatgaggcaagaaataaagataatataaatgaacaggtcactatgattatttgggttgcctatttagacaagaaaatagggcatcgataatctctcatgcctcctagtacaattggaaaagaaaactaatgctagtatcactaggaaaagacatagaagaattacttttagaatcatcaaaaaataagtttgaaagcttttgcaaaaagcacagaagtgaatgttttgaagcaaatgaaactaatgggaattataatgagacacatagcagttttataatcttgcctctcttgtaatgtgtcagagaacaagaaccctgctattttaacacgctttgtctatacggtgccaacactgaacttgacacgaagagaagaaagtcctttctgatgagagcatgtagtatctggatctgtttctagactatgtgattcattttaaagatttctaaggaaaggacacatctagatcatctatgacgttaaatccgctgttctgaaataatatcaataatacaaacaaattctaattttatgtatgtgaaaaaaactacttatataaactcatattcattcgagaaacaaatactccaagttggatatcaaggagtttcctttcagttatcctttgttcagtggatataaatgctgtgctccttaatactgggtacaaaaagaaaaataagtttattagaaatatacacatcaaatacacttctgaaaaaaatgagaagctattgaaatgaggtcaactaaacagaaatctatttgtagggtttaaaacaccatgaatgagatcatcttttgtgattccatctatccttgcatttctcaaattctattttgaaatcactgcctatgttcattgcctaaaatagcttttcctttgattcttagatgatcttatgaaaatgaaaatatatataaggctattttgcatagaaatgattagacatagataaatatttacaccaaacagtttagggagtggggactagttatttcagagattatacaatgaaaattttagactgatttaaacatattattttatatgccagtttaggatgatgaataagtaatgaatcactgaatttctccctcccttcctacccccagccttcttcacttctttcctcctttattccttcatttctttattgacatacatacgtagtgtgtacaccccccatcttctaaagtaaccccatgggaagaaacgctcaggtggttatattaaaaaaatcgagggtatgaaaatctcagggtcgtatgcccaaacaccaatgcgatataaaaattaaggtgcacatatatgatttttcaattttttcatttttatgtgtgaatgaatttggaagaaaaacctttcatacactccagactttctgtgttttgtagccacagccttcatttgcaactctgacatggcaagctgctgttttctagatttcatttgtgtgggcgcctgctgcacaccaatatatattttctctttacaaccatccaccatgtggatgcatttctttattagtcaatatatattctgtaggttacattctgcaaatttgaacatggacaaaatgcaatcaatataatccataacactgcacagatgtcttggagagattgcagaaatcattcaccaggaggctgaatgtcgaagaattataaaattgcatttagatggacaagtcagaaaacaggtttaaaaagtagtacatttttaaatttgtgatttcattatgaccatggaatgaggtaaaagcataactgtagtcagcaatttacacttaaatacagaaaatgcaaaagacactatgtacataggaggaaaggaggtatggatgtgagaagaaacaggagggagaagcctaatgaatgatcttcagatgaaaagaatcaatgaaaaatatccagctgtggttaaatgctttcaaattgccatttatgcaattgatgcatggaataggtatttgtcagtgcagagagtgcgaacagaacattattatgaaacagagcaggatccttggcaaaataccaatgaaatacagttttcaatagtaaggaaaatggagagtgtgaaataatgtcaattagagagaaatgcatgctgctgaagactctcggcactattcctggaagaataaccaccatgcttagaaatccggagagttctgggaaacaatggccacagaaacaagacttattgatttaaattaagatttcagttgtgcttaagaaacatgtaatgactacaattatatcatctgacaagaaaaataatatgtataggcaagagtgatatttaaaatgttgtacttaaccattcgtatcagatggatacagaacaatcaggcacaggcaatgaaaaattagaacagaattaaaaggtttaaaatggaaagacatggatgtattggaacatactggctgaatatcagtgcctgagggcaatggttgataaatctgtaagaaatttttcaatgcatatttctgagcacccttttgtccctttaatagaatgataatttccagcaaaatcaaaagtagtagaaataaacagttcaaaaatcccaacttttaaagaattaccttcatatgacatttgccaaacccctgacaaccatctataattgacaaaaaaaagcgagcataagttgactcaaattaataagaaagagctacaaaatatttagaaagtaggaaaaaatctaatatttaaaaaaattctgcctaaatcacctgtttagccgaagttcagaatagtgaacaatcagcaataatagatgtaaatcaatttccacttatggatgtaagtgccctttggaaatactttttgaaaagttaagagaccacagtggtaaaccatatactaaaagcaatctatgacaattttctaaggcctctgaaattctatacaggttctcaaaagtactattcagaagtgaaagttccaataatagatgctttcaacgatattaaagcaaaaacacaagaggggaacaatgacagatataaaggttttatacctagaaaagacttaatagctagacgttgtcacaaattactacactaacaaacagtgcatgaatttcagcttttcaacttaacaaaagatgggcaatatagtcaaaccatcatttacatgagctcttgaggcttgaacatattaataccaaattagaaactaagagcagattgtacccatacattcaatacagagttgctgaatatctaagtgcaatgtactgtgttagaagccataggaaatatcaatgttttttcaacatggatcctaattttaagatatgtatagtatacttggggataatgaaaatacgagtaggcagaaaagataactattgagtactgggcttaatatctgggtgataaaataatgtgtacaacaaacctccatgacatgtgtttacctatgtaacaaaccttcacatgtaccgtcaaacctaaaataaaagctaaaaaaagaaaatacaactagaaaagtaatattattaatatgagaattaattattttcatatggaggaatcagggaaggctccatgatacagcatggtcttgacattaagagtttgtggaattggtgttccaggtagagaaaataataataatgacaataataataataacagtaaagacagtgatagataacattattgtttctgatacccaataatctttgagttatgtcattttcattctccaaaagcctcacgaagttggtttttaattccattttacagatgaggaaactgaggcacaggaaggactcaaggttatatatctatcaatggagtggattgattagaattggatctgtccaattgcagagcccctgttcctataccgccttttcataaacagatcaaggtcagtttagttggcatgtagtttgtaaaagaaaggagtagcagttagactagaagggtgacttggagtctcctagctgcatttacaaaggcacatttaaggcaccctaatccaaggcatgttcatttccacaagctttaccacaattttttattaataccataaacaccaaaagaatatagtgccatcatcatagaaatccattacattaagtcatcaatgaaaagtatactcagaagttcttgaactctgctcatgaaattcagttatcttttgaatatcataggcatcatagaaaaatgcatgaagtttcaactacatcttacttgtgatactttatcttattttttattattattttatttcattttatttgagacagagtttcgttcttgttgcccaggctggagtgcaatggcacaatctcggctcactgcaacctctgcctcctgggttcaagcaattctcctgcctcagcctccgtagtagctgtgattacaggtgcctgtcaccacgtccagctaattttttgtatttttagtagagacagggtttcactatgttggccaggctggtctcgaattcctgacctcaggtgatccacccacctcggcctctcaaagtgctgggattacaggtgtgagccagcatgcttggccctttttttttttctttttttttttgagacagagtctggctctgttgcccaggctggagtgcagtggtgcaatcttggctcactgcgagcttcacctcccgggttcacgccattctcctgcctcagcctcccgagtagctgggactacaggcacccaccaccacgcctggctaattttttgtatttttttttttttaagtagagatggggtttcaccatgttagccaggatggtctcgaactcctgacctcgtgatccatccgcctcggcctctcaaagtgctgggattttaggcatgagccaccgcacccgatctatcttatttttaaaaattatcactcaacgtacagctcaaatcatccatagtataattttatttagctgaaggatggatttgtcattagttccataactcctgttctctctcttgactttattttttatacacacaacatttaaccagaagacagacccaataaaaatttattaaattatgaaacaggataaaactggacataatgagacaaacaaacaaacaaacgcaaagtggtctaaaatgtttcgatttaatgatgatagcgtaacctgcaatcattcatatatgagagaaggcatcatgaggatctcagctttgggataggttttccaggaagggaactagagcattagtccagccctgttgtttcagcaaggacccctgttagcaatgacaggcatttataagaagtgaggccacactcatcaggtgcagagcacagcaaagctgcatggctcactagagtactgaatctggcatcacgctcatgttatccacttagtaaccaatggggcagttttaaaaaccacaaatgtttgtagggatctgttttctctattaagcctctttctcctgcgaaacatatctcctgaagcatggagaaataacttatttttctttaaactttttttttttttaatttgagacagagtcttgctttgttgcccacattagagtgcagtggtgcaatctcagctcactgcaacctctgcctcccaggtttaagtgattctcatgcctcagtgtagctgggattacaggtacgcaccatcatatccagctaatttttgtatttttagtggaaacgaggtttcaccgtgttggccaggctggtctcgaagtcctgacttcaagtgatccgcctgcctcggcctcccaaagtgctgggattacaggcgtgagccactgcacccggcctctttgaacttttttttgttttgttttgttttgttttgtttttactggtttatcttactacttttattatacaatgcttttacaaaaaattttattattattatacttaaagttttagggtacatgtgcacaacgtgcaggtttgttacatatgtatacatgtgccatgctggtgtgctgcacccattaactcatcatttagcgttacgtatatctcctaatgctatccctccccactcccccaaccccaaaacattccccggtgtgtgatgttccccttcctttgtccatgtgttctcattgttcaattcccacctatgagtgagaacatggggtgtttggtttttggtccttgtgatagtttgctgagaatgatggtttccagcttcatccatgtccctacaaaggacatgaattcatcattttttatggctgcatagtattctctggtgtatatgtgctctttgaacatttgatcttggtatcttaatgttatcctttcccatccaaggaaaggtatctagcccattttctttgcgtttactccctccagatgttctaatgtctgctccaaaatgctgggtgaccccatcctagagctgctcacatggtatacaggatcatagcacttttgcttaagtgaattgacttatttcttgtaagtcatgcccagcagcattaatacttcctcctcaacacaaccacaagagctctggagggaacccctcctttactacaatgggggttttctctgctttccagtggggaaatgggggcttctcccatgatttactagcctctcaagactattgtggcaatttggtaagataatactttgaaaatgctcagtcaactctaaagtgcaatgcagatataaagtataagtaatagctactgaaatattttaaatatccttgggccctaatacaatcatgataaaatcagcagtcttctacataggaacaaataaaacagattctccccattaagtaaacaaaacttagggtaggcttgaaaaaggacaagttgtgaaattaaatttccagatttttaattcaatttaggtgttttctggtgccagatggtttgaagttcttaaaccatttttattttattttattcatttatttttttgagatagatagagtcttgctctatcgcccaggctggagggcagtgacacgatctctgctcactgcaacctctgccttccgggttccagagattgtcctgcctcagcctcccgagtagctgggattacaggcgcccgccaccatgcctgactaatttttgtattttttagtagagacagggttttgccatgttggccaggctggtcttgaacgtctgacctcgggtgatctgcccacctcagcctcccaaagtgccaggattatagacgtgagtcaccgtgtccggcccttaaaccatttttaaagcggcatgcatctttaacctttaatgtaaagaacatgatcatagaaaagtatttaaattttgaccttattcatgcaatgcaatgctttaaactgtagatgtcaactttgcactctatgaccacaaaatatgcacatatcacccttttattatagaactcggtaccactaggtatgatataaatggttactgagaaacagagtttgctgcatcgtgcttctagtgagaaatagttgcacagtatttaaggagttgttcattatgtaatgggaactttgtgcttagaacagctccacagggagaagcaatagagctagatgtaaaaatgttctccatttcacaatgtagaagtttaatttttgcagtatacttttccttatactatcataattttacatgttgggtaagaatttccatgaattctatgtacaatttggcctcctgtcatctttgttttgccctctccctttctcttatagttggaatgaaacagaggaaggagtagacagtatggcctttttctgattttgacctacattacattttgagagtttagagtaatggggaccatataataatattaatcaatcgataattatatatatatatttatatatttatgagatggaatctcactctgtcactcaggctggagtgaagtggtgcgatctcggctcactgcaacctccacctctcaggttcaagcgattcttccacatcagcctcccaagtagctgggactacaggcatgtaccgccatacctggctaatttttctgtgtgtgtgtttttttttttttttttttttttcagtagagacagggtgtcaccatgttgcccaggctggtctcgaactcctgacctcaagtgatccccctgcttcggcctcccaaagtgttgggattacaggcgtgagccactgcacccaaccccgataactttttctgtgtaagggcgtaggtactttaaatgcaaagtgagaaatgcagtattaccagggcagaaaaacatgctctgtgaacttatgtgaattcattattccttacttacaatgattgttcacatccctgtagtaaagaaacttctctacttacaacttcccataggtagcaataaaggtcccaggcacagcagaagcatggcaatgaagaataccaccaacagaggacatcagaacttactttaggccaccattaggttttcttagcctgtgttgtgttttgtgtgcatattttcataatgttttataaatattattattaacaccgctatgttcaaaagtacaaaagagtcaaaaaagtgttcctttaagaaaagacatgcgattactacggcaacaaaagagaacttattgtagaagggtgtacattgtatatattggtcacttttgtatgtcattttggacttaaaaggaaatgaatttccaaacagcccttgagaaccaattctctttgtagagaaaggaggttgtatgttgtctataaattataggatcatagactctttttgtttgttttttgagttagagtctcactgtcacccaggctggagtgcagtggcacgatctcggctcactgtaaccttggcctcctgggttcaagctattctcctgcctcagcctcccgagtagctgggactacagttgcctgccaccacacccagctaatttttgtacttttagtagagacagggtttcgtcatgttggccggactggcctcaaactcctgacctcaagtgatccccctgcctccagagatgatctggctgggcgtggtggctcatgcctgtaatcccaatcccagcacttagggaggtcgaggcgggcgagtcacctgaggtcaggagttcgagaccagcctggccaacacggtgaaaccccgtctctactaaaaatacaaaaattagccaggcatggtggcgggcgcctgcagtcccagctactcgggaggctgaggcagaagaatcacttgaacccgggaggtggaggttacagtgagccgagatcgcaccactacattccagcctgggtgacagagcgagactcttgtctcaaaaaaaaaaaaaaaaaaaaagagagagagagagttgataggatcttaaagtttatcttgtaaaattcccaggtaaaagagtaattctctgtaaaacatctttgtgcaagtactgttgattgtccccatatattttccattttttcttgtggcaatagaactcataattttcagttgggtatgtagatgcctgaaggaaagaatatatttcttagcctcacatagatgtaaatataatcatgggacaaagttctggtgaaggaactatcaggggatacatttcatgacagtttctgaaagattttctcacaacactgctggcacacgccctctctgtgcctccttccttcttccatgttgctgggggctggaactcagatgtgttggctggagctgaagcagacatattggaccatgtggtgacaacgagaattgaggccaccatggcaggacaaggtaaaggaggacttcggacttagtgaagcagaatagcggaaggaggcctgatctacctagttctgggcttgtacatgagagagacctacatttctctattgtttaagctattgttacagtttgtcctattagcagatgaatcagattaaaaaatgatggaaatttgtgaagcagcccatgccacttaataacaactctaacgtttacattttccttactcagagtaagctccactgtaacacttgcccatagttctcttctacaatcttacttaattaagtgtgctgtgtcctttacccaccctccccagatgcatgaagaagctgtcctgtattttcatgttatcttcttactgaacattctagattctttcaaatatttgtcatataaccatcgctatacctttcacaatcttggttgccctgctgtcaatgtattatgatttttcagtgttctcatcatacgtgatgctcataagtcaatatgactgcagatgtggtttaactagtgaagagattaatggaacatttgtgaatttcattaatgcaatctaatactgtattgcctcgtacagtaagccacaccagatcatactggagattaatacagtccttgtggttatttaaaatcccaatttgtttttcatataaagcgccacaaagtcagatgttcctcagcctatatttgtacaaaagactttaaaaatcttaaaggcaggacatcttgcttgttcttgttaaattttattttaatttttttattttggtacagtatcccagtctgttataatcttattttgagtcttgattttgatctttcagtgtgttgactcccattctcacctttgtgtcatttgaaaaattaataagtgcacaatgtatatgcttatctagaaaaatgacaaaaatctgggtcaaagtacaggcaaggaggcaccacttttagggggcactatttatggagggttgtgaaatgaagtagaactgaattcactctgtggttagcaccacaaaacacttctcaaattgacagtttaacacaacattcctccttgggcatggttattgaaacatcaccaaatttaccaaattatatttctctccatgtataattcatgtagtttaataagattgtgagcagccacgtaaaaggcactgctgaaattcagatacactgctgcagcataacaccactttaaaaaagccagttaagttggcaaagtaaaaaaaaaaaaaaagcctacaatattaaggtgaaaactttacaacatgactctagtgaatattaaagtctaaaataaaggaaaagaaacagttgctcaatgtttccaaatacggtttctcccagatttatagttttctttatttctttattttattattattttttgagatggagtttcactctgttgcccaggctggagtgcagtggtgcaatatctgctcactgcaaccttagccccctgggttccagcaattctcctgcctcagcctcccaagtagctgggattacaggcatgcaccaccacacccggctagttttttttgtattcagtagagacagggtttcgtcatgttggtcaggctggtcttgaactcctgacatcaaatgatctacccacctcggcctcccaaagtgctgggattacaggcatgagccactgcacccggcccccagatttatagtttttaagataaaagcgacaagccaaattaatgttttaaaaagctcgaaacatatggggggaaaaattaaacaaagtgccaagtagtgaacatacagctaaataataaaaagtagtcatactgatgctttgttattcaaaaatcatttttcctcaaagagtaagggtgaaaaattgtaaggactatcccactacatgttcaattaaatgactaaattaatgtagagacatttaattaaagttccactagtttttccaaatgctattaattacgccgctatctaaaattaaatctctccccaaacccttttacatttcttccgctcatctgatacagacataattaaaatgctgcaagtttacctaaacgcatccaaatattataaaagaaaatatgaaaaactggagtttcagtagctccttaagaagctggaattttaatgggatttctacaatccttggggaaaaccaatagatgtgtaagcaggcatgcacacacacacacaaactgtctcaagattcctctgaaaataaatttctctctttatatctaaggtgctgcagtgaataccacagacaactatagtttcaaaggttttctaccagcaaaagacaagaatttttgaagacactgggtaattaattgcaggcacaaggtgtactctagttataacacttctgtgctaccattttcgaaacaataagcattccttaatagcggctcagaaaggcactctttaagagaaacagtttggaattcaggcttccttgtattgtatccaaacttccaaatggaaaaaaaccagcctggacaatcccagcttcattctatatgcaagttattctccagtgagtaaacaaaggttgatcctaactcccaaacttattttattaatcatatacaagatgaaaacacattgatcaaacaaggtctactaacatgagacttctcttatttcctttctcttacttgattctgacagttgtccttttaattgctctgcacggatagtattcagccatctaaaatcaacaaattctctatttaccccagtcgtcttccagattgctgtaggttcattatgcaaatgttcctttaagaaatacagagttactccaggaatgaccactacctgccattactatggagtccagaggtagggtcaggtacaggctggggtcttttgaaagtgacttgtctcttttccaaaatttcatttgcttctaatcaagagtctggtaaattaggaggagtccttttctcactcatcatcgtagccaaagtctcatgagacaaggctgggtctcagtaggactgtgattcatgaaaagtcaattatggataaattttgtttaccaatatccttcctcattcctggttctgcttggcaaacagccatccctcctcccattctcttattacaagggtttgcaaacttcaccgcactttgtaatcctggggattttcaacaaatgctgatgcttggagcccacccccagagattgaattggtctgagatgcagcctgggcatgaggagctttataagctgcccaggggattctgatatgtggtctgcgctttaggcctgtcaaggtgggataacaacttgataataaaggtttatttcctgatcagttaaaggggttaccacatctcaaagaaatattttgcatactcaaaggacctgtaatggaatttaagttaaataatggtgttacaatatctgtaattaattttaaatatctcaacatagatagttggatattttatatgtgcagttagtgcaaccttcaactctagaggcttgaggcaaatggttattttaattaggaattcatattctaggacagcacagccttcatcttatgaaaaaggccaaaacccagagactgctactactatatatctctgtgaaccttggaggattttgtaatgcatgtaatagatatcgcaaatgtgtttttgctgagggaaatagtggattgcaatgaatatccctataggatctcattagtaaaatttaagacaatcaagatacatggattaactaaaatattttaatgacatcccctaacattgcataaacaggatataagaatccagcaaaacctgttgcttgggcttttaattttacgtctggtctccaatggccttgtatccaaccattggcttaggaagaattcttgtgacctgatgccaaatctaaaggtaagagaatactgtatttgcaatggtgtcaatttaagcctaaaatcctacacttcataaaaattgtagaacaggctgtaagctgacttctgcctgccttctaacaaatgttggttaacgacatgattgcacttgtggaggacttcagcatgaagcatgaagctgcggcttgaggtagccattcctcatccacctcaaacacatctgtggttctccattatttcccaaaaagaacctaatagttgcacgtgacctaaattcacttaggtcagttcacagcaggtggaatttgaggcagtgtgccaataaaatgagcggtaagtaaatatttggggtaagagggtcttctgcacaacgattaaatagttctaggtgattttctaatctcctcatttataagagtggtcccagcaagaacagagactgaaataaagtggtcgtttcaaagctttaaatactctgctttcagctactctgtccacttattcaaagacaaacttgaaaggaaacaggagcccatattatagcacaggcttttaaatttgtcaatatgaggaaccaggaaatgccctgttcttcttcggggctctttcatttagcttgcattccaggaatgttcatttgttccaagcaacattagaaattaatggggtaagtgctgggtgaatgtaggtaatcggtataaaggctgctttcttgagttaatgcctgagaaatcaccaagcctataatttcttttttcttttctttttttcttttttttcttttttttttgagacggagtctcgctctgtcgccaggctggagtgcagtggcgcgatctcggctcactgcaacctcctcctcccaggttcaagtgattctcctgcctcagcctcccgagtagctgggactacgggtgtgcaccaccacgcccagctaatttttgtatttttagtagagacgagtttcaccatgttggccaggatggcaccaagcctataatttctaaagtcctgtttcatttgaagtttgaatgcaaaagtactaatgactgcaggggagggatgttttctatatcttaagaaatacgtaaataatatgtggcatagcttctgatagtactgcaatataactatctataactaatatatacagcaaatatattatcacttcttttttttttttttggagacagtttcactattcttgtccaggctagagtgcaatggtgggatcttggctcactgcaacctctgcctcctgagttcaagtgattctcctgcctcagcctcctgagtagctaggattataggtacccaccaccatgcccggctaattttttgtatttttagtagagacggggttccaccatgttggccaggctggtctcgaactcctgacctcaggtgatccacccactgtggcctcccaaagtgctgggattacaggcgtgagccaccgtgcctggccctattattactctgcatgtttctgcagagatctgtagaaaattaaaaaaaaaaaaaaaagaatgctggcttataaatggagtagattttctggaaaatgaatgttttagtccgttggaatgctataacaaaatatcataaactgggtggcttatagacaaccaaagtttttttctcacaattctgaaggctaggaagtctgatatcaaggcgctggcagattcagtgtttggtgaaggcctgctttcttgttcatagatagcaccttcttgtgttctcatggcaaaaagggcaaagcagctctctgggtctcttttataagggttctaatctcattcatgtgggctctgccctcatgatctaatcacctcccaaggggcctacctcctaataccatcatatatggaattaggtttccacatatgaattttggggagacacaaatattcaagccacagcagtaaggcaatcacaaaatagggcagttagatttaagtgtaatatactagggaatgacaatgagagagatgtatcatcaatttctttgccttctcccctatcatcagggaaggtacctaactgctccaaggccacatgactccatgcgcaccaatagcaaaaactacatccaatgctttataggttaggaaagtacaggttcccacacttatatgtgctcacttccatttcttgctgcccctctctttatttacgaaaggatgagaacttgatccacaagtgatttcattgagatgtaactcttattttatccaaagagaagtgttggaacatgctttgattatcaggtgagggctctgtgcacattttcatgcaaatgtcttagattggtaactctcctccaatgaatgcaagaccttctgccttcggtgatgactaaggtggtaacagttatcaggtagttgcttggcactgacttatttactagacattctttttttttgttttttgtttttttccagagagtctcactctgtggcccaggccggagtgcagtggcatgatctcagctcacggcaacttccgcctcccgggttcaagcaattctcctgcctcagcctccccagtagatgggactacaggcaccaccaccacacctggctaatttttgtatttttagcagagacacggtttcaccgtggtggccaggctggtctcagactcctggcctcaagtgatccacctgccttggcctcccaaagtgctgggattacaggtgtgagccacattgcctggcctactagatactgttaaggcaggcatgtgctaaacaggtcacatgacctctactatccctggaattataatactagttagaacaatagttttcaaactttgaccatgacctacagtaagaaatacattcatcatagttacttagaatacattctccacacgtatacattcatgggtgtatgtgtgtgttgtttgtctaaaataccacttccccaggaaactttccaggcctactacaccaggtcaagtccctctgttatactctctcagcactctgcttttgtcctttctaagtactcattacaattggaatgaaataattgcataacaaagatgttgaacccatctctagatctgtattctagggctttctgagggcagggaccttcttcctctcttatagaacagcagtataggaaaaactgacctgaagcaataacattttgcacataagagctgcttaattagtacttgtgacctgagtaaatggataaagacctcagcaaggagatccctgggtccttttcttatttggaaatcttgaggtagagctggagtaggtcatccaacatgttcattggcatagcttacagaacaacagcatcaacatggtgccaggacagataggatgtatctggggagcaaggtgtgatacgagagcgggatgtattattaatagttctaccttttctcattattttttcagggcttgaacatgtttcttgttggtatccactcatatttattgcctctttcttcatctcatttatttattgtgtcattaccaacttaacccagttttatttatcttctttttgactgcctgttggcaaaaaaatatcaaaacttaagaaaaatgggtgttttctagaaagttgggtaaaaatacactattgttttgttgcttaatttctttatgctgccttgctctgtgaacaaagtagaaaataatacatttattttggaaaataagctcaataaagacaggagttaggaaccgtcccttgactaactactgagggaaagccctttctatagaatagaatttacatcctgtgagttggtcatgtttttagtaagatggattaaattgcatgtatatgtccagagtcaattaatgggaaacatagaaccagaatccaagtcaattttgtccattacttctttctcaagagtaaacaccctcagctggatgacaaataatgattgccaggcaaggtttatgttattacctctacaagtaggaagttgatgcaaagcaaaactctcacctgacatctgttttttttaatcacccttatagcaagttagttttaaagaagtgagaaagacatgcgtgaacaggcaattttgctcccagatcaaacttcttcttataaccagacgtggcttcatgttccagcaaagcaagatattcccaggccataaggtaacaaaggcctgggacactgtggtgtccacatttctcacttctatgaatgagtgcccacaggaatgtgttcataacatgtaacaaagtcaacttgtgagttgctgatacacatctctcttatgtcatacaactgctgccattagcgattcatggcagtgtccttgcccggcagtcatgcatatccaaatgaggcatactccctagctattacaagagtcctgtctggctgcaggcattgactgacttctcctttttatctcaacttaaaatcagtgccttgctcccatccagtgccacatgaaatccaaggaatcaaagtgtaatctccgctgccactcctcatgttcaaaacatggaccattatgcaatattaaagcatgaatcctggaactctgttaatgttgtgaaataggtgagtagttagcaagaattaccattctgacagtgcagtggaaaaacttcattcattgtaaaaagcagggagttgagtttctatatggggttgcctttcacgtcccctccccttgcagagataatgaaaaaatgcccagctatttttcagatgtgatgtttactttcttttccaagaggttctttggaggaatacacagaaatattttatagaaccacaaaataatagaggtaaaataagctttggaataaaataagcaaataagactagtttctagtctacgatttctgggaaaatgcgagaactttagttaaacttgtttattttattctaggtgaattttattaacttaaaggatcataaaataataatgatcatctctacttttaaaatccacatttctatcaattattatatgcatattccagtgtgtacagataaaaagatattcaagtacaactaaacctagagatttcatcagaaaataatccccaaaatgagctgctattgcaaaatggaaaatatgatgtaaacaggcattttgggctttcagataaacagcataaatttttgaacaggatacgtcttgttttccacaaagagaaaaacaaggtgtagtgaagagcgttgaattgtgtctgatttctgatcttgcttttaacaaatgagaacgtctcagctaagtcaaccagaaactatttcctaatctataaattaaagggtttggcctagataatttctagtcttttctggcttcaacccctccctgcttactctctctctctctctctctctctctttctatatatatatatacacacacacacacatatatatatatatatatacacacacacatatatatatatatatacacatatatatatacacatatatatatgtatatatacacacacatatatatatatataaacacacacacatatatatatatatatttttttttttctttttctttttgagacagagtcttactctgtcacccaggctccgggttcaagcaattctcccacctcagcctcccgagtagctgggactatgggtgcatgccaccacacccggctaaatgttttttgtatttttagtagagacggggtttcaccatgttggccaagctggtctcgaactcctggcctcaggtgatctgcctgccttggcctctcaaagtgctgggattataggcatgggccaccgcacctggccagattgcaggtatctttaacaggttggagtgttacctgaattttcatcaatcttgggaaacatatagctgctaacagttttaacttcctactctatgtttaactcgtttaacatattaaaacacgcagacaatattaaactgcagcaacacatggagaagaaaagcatcgtggaaatggggtaagatgggactctagaagtgtttaaaacctcccatgctgaaattttaagtaaatgttgacgggcaatggttaaattgtaaaataaatgaatttgttgtcactgaaatttagaatactcctacctcttcttatgttttgcccttttaagatacaaattaaaatttttaaaaaatagaagagctcagaaataaagtgatggggataatatgcatacctatactaccacacttttcctttcaccagttactttggaaagtatcctatggagttttgattttagtagaattcatgtgaggcaaaagatggcttattatttctattgtgtaaaatctccaaaccactgggcagttataagactttttttttttttaagctcaaacacaggtcaaggctataggtgggagttcttgaacaataaacaaagtgagaaatggtcttaattttttgttattgctgctttgaatgacacacagacacatgtactaacacaggcaagactcttgctgcacggatatatgtatttttgtagaaaagatcaaactaaaatgaattcactgcctggcatcatgttttcatctgccttccattttccacaagggtgtactccacttgcttagacttaggcaatttaaaaattcttgatcttaatgtcctctaaaatgtacagactttatagcttagattttaagagacaccattacctgacagggtaatgacagttttatttgcactggtgactggatttgctgtgatacttaagcaataatacaaataaaatgataatttttttgagaggatgtcagggaaggagaaagaaaagaacaaaatgcatcgcatttaacttggtttaaaaacacaacacactgcagcttcccaaagcttcttattttactggaaaaaaaaatcccttagcaattcatcttcctttgggcgcatgaatgacattttactgtgatgtgattataagaaacaaaatccctcggagatgctgccttaaaatatttttctttataatgttctgagctcgacaaaccttggtagaaaacagaatactcttaattatgaataaattaactaaattagtaacatgagatggatatgcaattaagggattgttaattgaaactggaaacacagctgtatacagcttagagatgaatcataccagtaatgacgcagatgtttataaaatgtgattatctttagtggagacagcgctgcatctcccaagcccattcttatattgtgtcactgaaatggtttttaaacccgtgaacaccaggaatcaggatctcagggacggcaaattaggctccctggatatgggaattagtgttgtctgaatgtcagcaatttgattctccagctttcaaagaatgtagatatggagccaacaacaaacatctgttagttgcatggtcttcaaaaaaacaaaaacaaccaaaagttgctggcaaaccagtccctgcttcaatcagagaagacggtaaagtatctgtaaacagtcacactgctgtgtgtgactgttagaaacatatagaaaagagaaccccagggcacagtgccagagaccttatgcacaaatggtaaatgccccctctgctggcagaggctctaaaacattttctgctcttttcccggcagtgaacccagaagaaaaaacaaaatcttcacaactaaggaagcagtaggaaaatgccgtcattacactcactgtatgttgaaatgtactaaaattatcaatattctgttgcactttggaaacttccgttttttgcttatccacaccattttcccccatgtgcaattcccatttgccccagggaagggaaatgtctctatggttctagattttaatcgagttacatgatctctgcatagactgtgattggacaaggttgaggggagactggatactgtgtcctaaccatagtttaatgattatggaatgaagggctcagctacatagactagtctttggaaatcaggtttttggtttctggacaaagcttgtggcattattcaaaccaacaactattaggctggatggtgcttacaaagatggaagatggtagacatcagttttttacgtaaagtgcaaactaaccactgtaaggtgtagtcaaaaaagaaataatacataattttagatattgaccaacagaagatatatttgtcaccttagcttagcttctctttcaaaattatcaatgtccttaacaaaatctagtgctgtaaaggaaaataaaacaacagatagtctgacattagttaatactttcctctatcaaaaggatgcagaaaacttagggcatcctccttgaattcaggggagaccttttactacaacgtttaacgaagtatttggatgacttgaggctcaaataaacaactcagttttccactgtgttgactgtgggcatatggggtgtagctgagttgtgagtctgttaaaagaaaatacactttcaggaatgaataaggagaaaaacgcaaacacataaaaagacacaccactatatatagttttctctctatgttggatacctataaatgtgggatttgttgaattttgatcacaaagtctttctatcctatgtgttagtctgcacaagtacaggctttgcctataatttcagtattgatttgctgttatacaggttccaacttgtctaaatttcattacctgaagggacagcttgcaattccatatacaggtataataaaagcaagatgagtacatgcatactgtgagctctgaaaaggcactttttctacaatggctgtgccaaattcttcatgagactgttattctgttgcaaatggtgataagaaagccaatatcatacattatttactagcatttgtactaatattttcaattctgaacctcattataatcacacttgtttcagaacccatttgtggacatacccagctatttgcctaactaacagctatttacttcttgttccttggtaaagaagctcaattatgttcagatattgggcaacaaaggacacagctctgaggaaaaaattaaaatctggtctaagccaatcacagtaagcttgtttctcatagccagtgattggcttaaagaggttcagtgagatccagttctagttgacacataagaagaaatttgttggggagcttctgggaaacgtttgcttttccaaacacagacacacaggcatgagtacacacacacacacacgcacacaatacagttatccttgaaccttattccttcttgccttggttattgttgtctgcggatatgttgcttggcgcagtgggaagccatcttgggaccatgaggaaaaagacaagagaatcccagagaagctgacctcaagtcttgatatagctaatctgttgaattaaccagctctaggtctgatggtctttggacttcagtttattttgattagtggttctcaaagtgcagttcctgaccacaggagtagcagcataacttggcaacctactagaaatgtagaatctcggactccacgctggacctactgcatcagaaacgctgggagcagcctgccagcctgtagtttaacaagcccccaggggattctgatgcatactaaagtttgggaactgtgctagattatcaaatgtctctattatttctaatgtgtctattattaacgatagggttttcacttcttgcctgattccactggagttcgtgttaaaaaaaaatatattcccaagtctattgcatcagaatctccagtgaaggggcttgtgaattaataatttaatcaagtgcccctggtgattcttatgaccagaaaaccttgggaaagacaaacttaagaactttaaagtcaggtatctgttactggcctctgaaagtattctaactgacattccatctgcaatctcctgtttcaactggccgcagctccaggaccactcaggtaagcagatactagctcttgccttggcaaatatattatgaagtcttagcttggagagcctttgacttaaagtgaggtttacatttctaagatgttggtttcttgacttaactgtctatttgaattcctgatcttttccattcagagcctgtttacccgaactccccacttcagctacagtctgaattcctaacctcgtgtacattcttgatcagtgttatctggtggcctcaccaaccctgccagaatttcagagcccctctcaagtaattacaggggtaatcatgcattccttaactcttaggctgcattcttagggggcagattcctacctactaaccttgaacctgctgatgcccatgaggctggcatgaaagcaggaacaattagtctgttaaaaactaaacatatattcctgaagtctgaaaaaaggttctactcatccaaatagaaataattgagaactctaaaatatttaactttaaatggtctggaatcatcaatgttctttcaggttgaatgaatattttacattaaaaactttctgtcccttgtttacttggccaaataaggtaaaaaggtcaaaacaatcttagtgaaattgtttccttatgaatgacaaatgtaaagagtcaaaagaggaattaaggtaaataatttaattatatttcatctcccctaattacatgtttttcatttgcttagatattacttatttcacctctgctgccttccccaccatatacccgataactcagtcattccagacttataaactacctcaggttatatcagatcttcccagacctggttttcttcctagaaaaccattccatttttttctttacctcttggaaccctactcattgctcgagtctaagctcaaatgtcaccccttgtgcaaaatttattgctaactcttctgcacattaatatcatttctggggggctcacatctctagtggagcccttgtaatactgtatgtagttcatgtattaatcatctttgaagggagcctgtgtcatgtacatctttgtccctcctattgggtagagggtctcgagactaatgtagtcactgataaaatactgaactgaacttcatgcaaaagtgatttctgagaaaaggcattaaccaaatagtgccttaattttattacttgttttgcaggttttatgtacttaattgcaagtaggaggctaatgaaaaatgtttagtttttgcagtgtggtggtggtgaggggcatcccagcttgagtggtagaggtcccagcttaacacagaaatttagataaatgtggcaaattggtgggatgggcaatgtatctcatctgcactgagagaaaagctcaaggtgtaaccatttctggggctacatgtctagtcatctctaagagattggtggctccccagacatccattgcagggacactaaggaggtctcttaggagaaggcgtaatgaaagaacatattataaaccaggtgctttgctcagtagaaaagcctcggtcaacaagagaaagagaaagagtggttttgagaatactgtggtgtctgctacttagatttatcttctggttcagtcatatctgagtcccatgcatctaagtcagaattatttgcaagaccatgtgccagatgagatgctttctgctgcaggttgtagaaaactgatatgggttggatgtttgttcccttcaaatctcatgctgaaatgtaatccccagtgttggatgtggggcccggtgggggagactggatcatggggctggatccctcacgaatggctcagtgccattcttgcagtaataagtgagttctcactcagagtgagttcatgtgggatctgactgtttaaaagagtgtggcacctcccaccccctcactccatctctcaccatgtgacacgctggttctcctttcaccttccaccatgattgtaagcttgctgaagccctcaccagaagcagaggctgtcaccacacttcctgtacagcctgcagaaccatgagccaatgaaatctcttttccttataaattacccagcctcaggtattcctttatagtgatgcaaatggaattaacataaaaacccaacacaaaatgtcttgactagtcaaggcccacagaggcaaagctgctccaggactgggtaatccagaagcacaatgacattattccaggttcctcccatccttccattctgccattcttggtgaactgtccacatactcacaacgtagctactgaaattctgatctattcactcgttcattcaacaaatatttaccacgctaagatctattcttaggtaatttggatacattagctaacaaaacagacaatatccctggcctcatggagctcaccttctcatagtgaaagacaatttaaaaaagtatattaggccgggagtggtggctcatgcctgtaatcccagcacttgggaggccaaggcgggcagatcacgaggtcaggagttcgagaccagcctggccagcatggtgaaaccccgtctctactaaaaataaaaaaaaactagctgggcgtggtggtggatgcctgtagtcccagctactcgggaggctgaggcaggagaattacttgaacccagcaggcggaggttgcagtgagctgagatcatgccactgcactccagcctgggcgacagattgagactccatctcaaaaaaaaaaaaaaagtatattacacatgttaatcctgcagaatgagtgtatgataggaaaaaccagaaaaaacaggacagatgttccttttgctatatatcaccctagaacttactggctaaaaataaccatttatcagtattgctcatggttctgtgagttgactgtgctcaggtgggtgtttcttgcttgggttctttcatgtgtttgcagtcagatagtagccaaagctgaattgatctgaaggctccattggaatggctgttacagttttttcacttgtacatctggctcctcacttgggatggctgcggatcttcggccaacagctgggggctagccacgtatttgtctttccatgcagcttccccatgtggctagcttagatttgtggcttcttcatgtagacagcacagtggccttagagtagacttagtacagggcagatcactttccccagagtgagcattccagaagaccaagacagaagctacaagactccttcttatttagctttgaacttcttgcagaatcaattctacctccttcagtttgttgtacaggagcagcccagatttggtgtgttcctctacacaaggaacaattgcctggagacatgattcacagggaggagggagtgccttcctagaagagctatcataaaaaggtaagtgggaaatggattcagatggctgggaagagggagatggggcagttgctgtctaattagtgtggtcaaattttaagaaggttttttttttttttaagttgagatttgaataagacttgaaggaaatgacagagttagtcacaaagatttctggagaaagaatgttccaggtagaataaagaactacgcatagtgcccggagaaggatgcctgtttagttctctagacgagaaaaacctttctcagaaggtcccttagctgaatgccctttgtattttattacctaaaattgcgtaatatgaccatgtccaattccgaagagggcaatcaagactgcgagagcaccatgaaatagctcaggactatcattatgtattcccttgggttggggcttcccttgatgcacatgatatgcagaggagggtagatcctcaacaagcctggtggctgccagcaaaggagaagggtgtatatggacacatttggggaaaagaaaacaagagtatctttcttccccacaccctggggattaaacaatactccttttgggcctgtctaacaggacaactcatcccattttcccagccctagatcctgactatcagcagagaattcttgtgcttggtgtaagagcagaaaaggctggaaaggcagcgataatgaccaggatcagcatctaactcacccagtggcaaaggggccaccacccacagaaggtttaaaagtgtacactcaacagataagcagtaggtagcattcataatgggaaaatatgactctgaaagaaaatttttatgtggcactgagatactttgagatgcatgatcaatgaaggacctaattcaaagagggtaacattaaaattcccaagtacagcacagccacaaaagctgtagccacatgggcaactttactgcccctacagtttaagtgtctgatgggaatgccagacctaagaattggaattgggggtcctgacttgtttgaagcaagttaaggtcttttttttttttttttttttttttttttgagagggagtctcactctgtcaccagtctggagtgcagtggcatgatctcagctcactgcaagctccgcctcccaggttcatgccattctccagcctcagcctcccaagtagctgggactacaggcgcctgccaccatgcccggctaatgttttgtatttcagtagagacaggatttcaccatttggtcaggatggtcttgatctcctgatctcgtaattcacccgcctcggcctcccaaagtggtgggattacaggcgtgagccaccgcgcctggacaagtcaaggtctttttatatttcctcagtgtcacttacaataatccacctacacttgattttctctgttacaaaaagatagtatattaaaaggtagttcagtcgatatttatggatggaaacagaggtgaatatttagaaagactaaatcaaactgagataataaagaaatataagctataattcagaggaatggaatgccaaaagtaaggggagtggaatctgaagttcatgactatgctctcatatttttttcctgccagctgttggtagaaattattattatgatgatgatgattatgattattattattttgagacggagtttcgctcttgttgccccggctggagtgcaatggcgtgatcttggctcacagcaacctccgcctcctgggttcaagccattctcctgcctcagcctcccgagtagctgagattacaggcatgtgccaccacgcccagctaattttgtatttttagtagagatggggtttctccatgttggtcaggctggtctcgaactccggacctcaggtgatccacccgcctcggcctcccaaagtgctgggattacaggcgtgagccactgcgcctggccagaaattattatatgaaactagaagcctgttcaattttaacaaaaggatgcagatatgatgcaactgttgaacataagacaaattaaaatattttctttcttttcttttctttctctctctctctttctttcttttttagatggagtctccctctctacccaggctggagtgcagtggcatgatctcagctcactgcaacctccacctcccgggttcaagtgattctcctgcctcagcctcctgagtagttgggattacaggcatgcgtcaccatgcctggctaatttttgtatttttgattgagacggggttttaccatgttggtcaggctggtctcgaacgcctgacctcatgatctgctcacctcggcctcccagagtgctgggaccacaggtgtgagccaccgcacctggcccaaattaaaatattttcattgcaaatacaaaataccaagaggttctatatataatctttgaaagtaccctttctatttaaagatcaggattttttttcacatgtctagaaagaaatttggttcaattctattcactatgtatttattgggaacccattagatgtgtaatataatcaaatatcaatagattatagaaaagaagagagtcctttttcttacaacccagcagggcggaaaggattaaattcttcttataaagggagaacaaatagattagaaaagacgctgcgtagtcaagttcagaaaagtgagaaagtttagaaaggtttcatagagatgaactgcagttctaataataaaacttaacatttttataacatttgatagtttcggaagcagtttcacagaccttatctcattgcttcacatggaccttgtaagacaggtgggatttggataagtagttcctttaaaaaatgtcttcgaatattgtacatttagactgacaaatgcctttattagaataaagggaaaaggtatgtgagagacatagagagcaaattttgggttctagttccacaactaactagctgtgtgaactatgaactatcatgtggtgtctttgtaaactcaagggttggatttctggactttctgtgctgaagtgtaaaactaaaaatattaaaatattcagtaattcaaagtggatattttaaaagcaatgaaacatatcagtagattcaattgttttcttatttatttttatgatttgatattttatatttttagatttcaatttttattttagactcaaggggtacatgtgcaggtttattacatgggtatattgtgtgacactgaggtttggagtacagttgaacctgtcacccaggtagtgagtatagtactcgataggtagttttttcagcccttgtcccacaccctcctgcccttgtcactagtgcctgttgttcccaactttacatccatgtgtacccaaaggttagctcctgcttataagtgagcacatgcattatttggttttctgtttctgctttaattcgcttaggataatgacctccagttccaaccatgttgctacagaggacatgatttccttctttttcatagctgtgtagtattccatggtgcatatatgccacgttttctttatccaatccaccattgatgggcacctaggttgactttatgtctttgctattgtgaatagtgctgcaatgaacatatgagcgcacgtctttttggtagaaaaatttatatttctttgggtacataccaagtaatggaagtgctgggtcaaatggtagttcttttttttctttctttcttttttttttttttgagacagagtcttgctctgttgcccaggctggagtgcagtggcatgatctcggctcactgcaacctccgcctcctatgttcaagtggttctcctgcctcagccttccgagtaactgggattacaggtgtctgccaccatgcccggctaatttttttgtatttttagtagagatagggtttcaccatgttggccaggctggtctcgaactcctaacctcaggtgatccacccacctcgacctcccaaagtgctgggatcacaggcgtgagccacgacacccggtcatttttttcttggagttttggcaaaactatttaagtgttggttaaccttatgaagccacaaatttagatgtaagtactacgtcttcagaaattatagtttttttcccctaatttttctcctctggtataactttctgcttatttttatagttttcagtaacattttaacttagttttatgcattcatctattcaagacatttatagaatgcttactatatgaaagacactgccaaatgtcagtagatgtggtattcagggcctctgtccttatggagctcacattcagataggggaaacagactttcattaaacaagccaccaaacacatagctatagattttcgtaagtgctgtgaagaaagcaaacaggatgctctctgtgataatgatgggaaatcttccctagatgtgacttaattatacattaactctgcagtccattacttcaaatgatccctagttattcaatttacatactggaattttacaaccctgtttagttagtcccaggcttcaggccatttaaaacaaaagatatagatgaatagaagagtcactcagcttgtcttcatccttcagatctcggtcaaaggtcacttttattgggagggtgtcctgattgccctttcctgcctctcacccttactgcagcgcgcgcgcacacacacacacacacacacacacacacacacacacacacacacacacacacacatttaggtccttactatatattctggtagtgtcctgtattttctttcctgacacatttgtaattattttatgagatttaaaaaattactgtctgtcatcccaagaaaccataacctccatgagggcagagaaggtctgtctatgactgaatccctatcatctcaaacagagtttggtaaagagtagacaccagaaaaaaataattattgaatgaatgattgaacaaaggaggatttccgttcacttcagcaagactttgatgattcaaccctcttggtcctacagaagagtgattctagtttttagtctgtgaatgattcaggctctgagttaaacaggcaattcttgagatcgtggtctgaaattcatacaaccctcctactttaaatttcctcaactcatgatccaggtgattcctgacaaattaataaatgtgagaatgatgctgttctttttgtttaaagggtcgaatcataaatgaataggaaatgttgtcatgtcaattcaactttttatcagaggagtggtactgcatagttaggagttctgacagattccccaggcagactgtctgggttcaaatcctggctctctcacttacctgatatatgaccacaggcaagtcacttaacccttgggctcctcatttttctaacctgtaaaatgaggttaaaattgtacctccctcactgggttacgtgaggcttaaaagcattagcacatgcaaaagtgcttataattgtgaatggcatacagtaagtgctaggtaagttctcactattaatctcagtaagcgtaatgctcactaaaattattttcaaatttataccatatgactacattgattgtctgaataaagtaaaactatgtataaaggctgtacttctgatataagaatcatcttctaatttattatatttccaccctcccgtctcctttagtaaattaattaatatattaagggagaggacaacttatatcacagtgatcattatattaaggacattatagcatttataaaaataaagaagtattatgataaactgtatgaatttgaaattcactttgtggtatttacctttaaaagtagcatttctgaatttcatacgctagtttccattcccctttatggagttggctttaacacgcagcttctcatgtggcctgaaaggggattctttctactttctagaggaatgtgctgtgaaggaggagtcgggaatcttactggcggccatgtgagaacagcagctctttgaatgctgggtatgatgtagcatgggaactgtgagcagctactggcggagtgtttcacatgcagcgcagcggggcagtgggaaaggcaatgaagaaaacaaccagtgcaaacaaatgcagaagaaagggtggggcggggtcaaactccagggaaggagagaggtcagcccagagagacaagaacacttacaagaacaaagaataaagcagtgagaaattggagacaagggcaaatgtcagttgcagaataagggaaaaggacaagaaaacatgaccatcatggcaattttaaatgcctggaattatatacatgtttctagtaaggaactagaggtctcaggaaactaaaataaatacatgcatgcataaatacattttgctatttaaacacatttactaggaacacattccatttttaaaaacaataataaacacacttacatggattaccataatagctagccttagaactagcaaaaatagttcccgattaaaacaaattagaaattagtatataaagatcaagcaatcaagtagcctaattaatactttataatgatttgggttcactttataaaatatctgaaaataataatatgcttttcattctcttaaattcataaatatttctttggctcctgatggcttcattcccattttatacttcatataattttttcatcacattctgtacatcgttcatttatccccctgtagtttcacacatcctgatgccttcaaaaaaaaaaaatagagaattcccttgaaaaccagaccattcttctcctagggtgagaaagacagactctggaatatttgggccatattagtttcaaggctacctgagcaatttcgataacagtcctcttgactaaagtacaattagttgtacaaacattgaaaaccaaatgttcttaagcttgacagtacgctttgacctcagtatgctctaagggtggtcactaacctgggcatttaaatttatactctccttcttcaattctttaaagggttttgtttacatcctttttttcctaacagagttgaggttaagcataaatgattattctctccttactgaaaagatgttttcctggaacttaattgtccttttttcacgggtcattctattcctaatatcaacaaatccttctgtgacctaaccttttcaaaaacaaacacatacttctttcttttttttatttcctttacttttagcttttacaaaactctggccagtgggcacatcagactagatattatagttgaaatatttacataagagcaacctatagtttagaatatgttagagcagtttttcctacatcttactgcagtattttgggagaggtgctttctaatttgttttaaccctgtgtatttctcaataacattccaaaaactggagaattgccacataataaaagtactacttagtatctgctaattgagaaaaggctattagctgataaaaacttgtatgctttgtaacacaactgctttacttacaaaaaccagtggtatatgggcaacataattttgtattcaagctacagacaatgcttgatgcaaaaatatatttttgcacctctctgtaaaactctatcatctgtagtttgggaatgaatttctatatgtggttacaaatagacagcatctcctgggagcatgatagaaatgcagaattgcaggcctcacccgatactaaatttctgggggcggattggtttaacaagctttgcaggtgattcttatccatgctagattttgaaaacttttaggccaatgctatccaacagaaatataatgagtgctacatgtacaattttaaatgttctagtaggcacatgtaaaaattttgcagaaacactgcccattgttgtagccgaagcaacaggctcacttcattcattttcaagaaaaataaccaagtttgaataatcataataaatgagtgaaattcattatgacattttacccaagcaaatacataaaaatactatcatttcaacatgtaatcaatataaaaataatgagatattttacattctttttttggtactaagtctttgcatcctgatatatatatatatatataacatatacatattacatatatatcatatatataacatacatattacatctatatcatatatataacatatacatattacatgtgtatatattacgcttactacacatctcactttcgactggctacattgaagggctcaatggccatatgtagctatcatattggacagcacagttctagaccatgtgatttgaaatacagtaaatataaatccatatagcagcaaattgtgtttctggggatctattaacagtttcccttcatcctccacgtttccctttatcttcctctttctgcctcatagaaaagttaagtgcttggttctccatgatcctgcagcacttgaacactcctccaacacagagtttttgggatggcattatacttaatttccccagagtctaaacccttcacagtgtcttacagaagtcatatatatatttttttaacttttaaatttgtctgtacctgacaagtacttaacatagaacaggggttatcaaagtgtggtccatgattcagcagcattagcctcacttgaaagtttgttagagatgcagattctcaagctccacaccagacccactgaatcatttgaaacttggtatgtggagcccagttatctgtgttttaataagccttccaggtgaatttgatgcttgttaaaatttgagaaccactaatgtaggaaaacatatttatttggagaatggcctcatatttatcattttctcctgagttctgtggtagaaccacaagctgaatcattttagtcttcttaaagaaagaaaaagtcaagaaggacatgctagaaagacatcggtagatgtcttctccttatccccagttagtgataggccgacattatttgtaagagcagatggctaggctctctgtccagaagtgaccccataatgcaaaatgattagtacaggatcattaaaaaacaaaaaagaaagatatgaggaaaatgttcaaaatctgtcaacacatttaaaggatcaaatcctgtgctcaatgatggtaagaacaaacatacatagatacagataaaagacctgcttagaaaatcctatctcaccaaagtaaagaatataaatggttctgatataagaattgcttgttggaaaaaaactggttagtttttttaaaatgaagccacacaaatactcctattgtttagctaactatgatcccatcacatcctctcacaaagcttactactatgactatatagaccaagtttccagtaagaaattattgaataatttgtaaaccagagataataatgggtactgcttttgtagtatcagtgttatgatagtatgtaagtatgtatatttctggtttttaacactgagaaaggatgagaggggtgggccatcatggaagtaataaaagagaacccatctttaaagctttacttaatatagcataagcagtaaagggagttttgtttagtatgtccttggaccaaacaggatcattacaatgtcttctaggtacacagtagatgctcaatcagtgctgactgaatgaaagaacaaagggatgaaagaaggaatgaagtttgcaaaagatgaggctctagatccctgcgacagcaagttaccacagaggtatacagatggagtgtaatgatgtctacatgactttggaagaagcttaggaaacctttaaaaaacatacataatttatgatactgttctttgacatatgtaaagaatctaatagctggaaatgccttcatattattcagattttaaaggtgtttgcattccatgagttcctacagtcaataaaacaaatactccttatgttaaagtgtttttgcagcttttgtgctatttgtgggtttactcatgagtaaagaaaaatggtataatattcctttatatactacttgcgcttggtgaataaagagattgactgcattactcagtgtgtgtactatttcaaaattagaaaggtttatcatcattttaacttttttctcacctggtttagatattcgtttctacttggtcaaatattagcattagtttggctttaagagctgattcactgaaatcacttttggctgattttagtacaattgctgagttctaaaggcaatgaggaatataatgctttaaaattttatatttgaaacaagtgtgatttctaaggggtacactgaactgggttcattaatccattggtttataaaaggaagatttaaaagttaatatacctaagaatcatttcaaaaaagaagatacatgtaaaaaagtgaagtattttacacctgtattgtccaaaatagttttaaagtattgctttttttttttttttttggaaatggtgtcttgctctgttgcccaggctggagtgcagtggcatgatctcagcttactgcaacatccgcctcccgggttcaagcgattctcctgcctcagcttcccaagtagctgatctacaagcgtgcgccaccacacccagctaatttttgtatttttagtagtgatggggtttcactatgtgttggccaggccggtcttgaactcctgatctcaagtgatccacccgcctcaccctcccaaagtactgggattacaggcgtgagccaccacacccagccattattgctttgttaagtccaaacgtaataggattttgagaagaggagacaaaaagagcatgggaatagcagttcgaaaaacctgactcagatcttgactgatacaagttatgtgactgtgactgtggtacttcatgtttctaagcctcggtttccttacacgtaaaagggaataatgataataggtaatcataatcataatacaaaatcacaaggttgtgattcttagatgagagaatgcacatgaggactttttctaactgcaaggagtgatggtttcctacaccacaaaaagtcaaatggtcaaatagtaacatgcataccaatgtgtctactttgaggaagaaaataggacttcattcccacagaaaatttcaaacaggcaaaccaatgtctcttacatttctattagaagattcaaagtcagtttggaattctctatacattatgattctatacataggtaaattgtgactgggtttgactgtattgttggtgctcacatcccttaactggtttcaccattttgactgatattacagacagctaaaaaactagcatggctttccttgaaaattaaatgaatggataatgcaaagaacccaggatattctgatatcaagtagacacggcctgatagtatgtaactctaatctttctattatactattttgcccaaatttaagactcttcttcttttctcaggtttacatctgcctttctactactccagttctctatttttattttattttattttatttttgagaccgagtctggctctgtcgcccaggctggagtgcagtggcacgatctcagctcactgcaacctctgcctcctggtttcaagcaattctcctgcctcagcctccagagtagctaggattacaggcacgcaccaccacacccaggtaagttttgtatttttagtagagatgaggtttcaccatgctggtcaggctggtgtcaaactcctgacctcaagtgatccgcctgcctcggcctcccaaagtgctgggattacaggcgtgagccaccatgcccagagagttctttactttttgattgttctttgtcttagtggacagaggcaaagatgaacttgtacttggtttttatcacgatttaaagattgacatagcattgtgactaaattctttattttcatagaaatatgtcttttttgacatttactatttaaaaaaatatgatgtcataatggtggtgggctcaagcttcccgccatagaacttggataatgcgttagcctcacatacattgttctaaatataaaatattctcaacaggatgtatgaattgcttttccagtaatgggaaaaaaattgcttgatgtgaacctcatttcttgctttcttctctttctgaacaaggcctcacatttataatgtagcagaattactatcaaagaaaagaatggaactaacttgactcggttatatgcaaaccaaaaccttggatttatcagctttctgctaaaaacactttttaagcatatctttaaggtcatgttcaaaaatagaaacatgaaatttgctacaatatagagcagacaccacaaactgaactgtttaataggagaaggctgtgtatatgtgggtttagggaagaagagattaaaagttagagttatacaaggagaaatataatttcaacaaaccacatttgtattatgaataaagaaaggaacttcattggttttaaactaaattctgtcaaatgtgtatctcccccagatatctagagacagaatcataagattgaactgtatgtgaccttagacaaaatagatttctgcattttaaaaatgaggagaattaaagctgagagaggttaaatggctttctcacaataacacggtcaaataatggctgagcttaagtttgaagttagacctcctaatagtcaatccaatgctcttttcgctatatcatactatctccttacatgtgttttcctgtacttataaccaagtttttactcattgtaaagaatggctacatagtaagctatttactgtttttgataccttaaatgcaaataaatagtgcaactagaatggatcacttagcattgattaaaaaaaaaaaaacttttcttactagtcataatcctttgacctcatttggaaatctacctgccactgtcacaaatcttttaccacgttctgaaagcaaacgtggcattctgctctctaaaagaaattataaaatatacttctagaacacttatatgggactaatgtggccattggttttctttggacatttattactttccttatttatacttaagatgaaaaacatactaaggatggaacagataaaattttaatagtactcaactactatggagcaaacagagaaaggcatataatcacttagctatatcgccttgctttagtcgatgccacttataacaatctagaatacaaatctttcaggactatccatcacaacaagaattaaattatgtgagatctcaagaggtctgggatttgcaacttatctttattaaagatctagcaattctttaacaggcctctcaatcacacccctaaatggactgacaataggaaagtgatttggtttattatatttttcttattaaaaagttaaaaccaaatagttttaaacccagtttcctcagaggcataccttctgcatcctgttggaaaggagaaaattggaaaggagagaaaatgattctctaattctacggttaaactaattttagggttttggggtataacatggtgtccttcacactgagaaggtagacgcacctcttccaccactacaaccattactctgcatgaattaactcattcgatgttacagtaaccatgttagagatgagtaaatggacaaccacagagattaagtggcctcaaggtcactcagctaatatgttggattccaaaacctgtgtactgtaataataataataataacaacatcaagagctagaatttgtagagtgtttatcatttggcatgttcgctcccgagcactttccatttattttgacttattcatcctaataataaactgatattgcagagaattttattatcgcatttttttttttttgatgaaagactgaggctcagaaaggttaagtaatttgctccaggtcccatggctagtaagtgtgaccttgagcagcacacttacattgcctgtatttattacgcaaacctacgaaaaacttccacatgtaagtttgtgataggatgctctttctttaaatgacttttggacacatcttactattgactcttgtttaaattaggattctaaagggaaagatgtttttgagaatccaagcagtaagagtacaaaggaactgcatggtggcaattcacatcttccatcatgattcagcattattttctgtttatcgtaagaatactgctacacagagtttggatgttccctctaactcgcgtgttgaaatctgatcccccgtgttggtggtgaggcctagtggaaggtgtctgggttgtaggagtgaatccctcatgaatggtttggtgccattctcacggtagtgagcgaggttttgctctagcagttttcatgagaactggcacctcccctccctctttttctcctcctctcttgccgtgtgatctttgtacaccagctcccctttgccttctgccatgagtggaagcagcctgacgccctcgccagaagcagatgcttcttgtacagcctgcagaactgagccaaataaacacctgttctttatgaattacccagccccaagtattcttttatagcaacactaaacagactaagacatatactaagtcttagttgcttccaaaattaatattaataatttgaaaatgtttagatgggaattataaactaatataaaatatcctatcctcacaaatattaccatgaacattacatgaaaaaagtactttcattgttctttacaaattttatctgtatattattttactgtaacaaaggacaacaatgtttacaatgtgcttacctgcagaagcttccatctggtgttcaggtcttccagagtgctgaggttatacggtgagagctgaatgcccaaagtggtaagctggcgagcaaggtcattgacgtggctcacgttctctttcagaggcgcaatttctcctcgaagtgcctgtgtgcaatagtcaaaagcaaattggaagatgagaatatttaaaacaagaagaactgatacctgggcttattctctttagggtgcagtgccagtaatgtttgctctatgctacggtttgaatgtttgtgtcccccctcaaattcctatgttgaaatcctaaaaaataaaaaggaaacgaaatcaaaacacctaaggcaatggtattaggagatggggcctttagggaggtgatttttgggattagcgcccttataaaagagacctcagagagctagctagctcctttcagcatgtgagggtgcagtgagaaggtgctttgtatgaggaatgggccttccccagacaccaaatctgctggtattttgatcttggacttctcaacctccagaacagtgagaaataagtttttgttgtttcacaagctatccaatttatggcatttctattatagcagctggaacagactaagacagtctcttgtggtagtattataacaatggatatttgttaatgggggaataatgataactactatttgttgagcacttcctaggtgcctaatgccatgatgagctctattcatacataaactgattttatttctacccaacaatcctatgaggccagtagttggagaattctaattttatacatgagaaaacaaacttgcagaggtttgttttcaaaacaaacaaaccttgccaagctctcatgggtaaaaattgaggaacctgggatacctatatgcaggtttgcctgcctctagaatatatattcttaactattatgttatatgcttcccctaagaaattctggattggcaaagtaacaagaaaaatatattgctgctggattctaaattctactcatgtcacaaccagaaatggatccttattttttacaatagaaagatatattcagtcataaaatattgcatgcatactttgcaccaaccacatcataacagtttcatttagggagtagggtattttgtcaagtcctcagaatgacttcctgatctcctggtattttagcccttgtagcaatgacttcagaaggctcccgtggggcttctcagctgtctttgaagcactagagcaggagtctctgatgcaatacatcatagcaatccgttgagcagaagaaccctatgcagatatggggaggatattaccacgcctcatatctaccctatcgagatggcatttatggatctttaacatgatgcatgatgtccaaatgttccaataagcaatttctaagggacaaattccctcacttaggagaacagtttgtgtaatgtaatgtctgtgtacaaggacagcaccacttgactatacgtgttgttttgacttgcttgatctgggcaggtgttatttctctgtctggttcactatgttgataaaaccattggttacactgacctcatttataagccttgcatttcctcccactccaaataaaaggagccagtatgaacattcaaaataagaacgacattatcctctcaaatcaacctgaatacttcatcagtaaaccgtggtgctgtatagagcataacactgttgtgtagttcttagataatacaaaacattgtgataatcactctgttgaacttaaagttttaaaaagtggtcattaaaaacattacgttaagcaatcagggggtttcttttggacgataacgaaaatgttctggtattaaacaatggtgatggtggcacaatcttgtgaatatactaaacaccactgaattgtacactttgaaagagtgaattttaaagtatgtgaattatatattaataaaaacaaacaaaagagagccccttctgaccatacacatgcaaaaaaaaaatcatatgtgatgtattcatctgtattcaacttcgtgttagtggaatgtcactggaatcagtgtgaaattcagaaagttttataggggtggatagtaaatattgttccatttccttatgaataaatacatggattaaaagtatcagaataagggcccatggagaaaggtggtttaaatccatatatatgaatacttatctctaaaaggaaatgatccatattaattttgttttgcataatagaaaggttagaaaacagatttcttaaatgtcaatgggggaaacttggacaaggacaacggttacaaaatgaaatcattctcttctggataataacgtgcatttctagtagccacaaataaatatcatgtgaggggaaactgtaaacaggaacctctgcagagagggcaagccagcaggcagcatctttcagtgatacaggtgagtcctttgtgctaatcatctctctttacaagcaagactctcaagccattaagttgattatcctacctcgttaagccatagctagatttcagttccctttaggtgacacaatgtacattttcaaatgtctcttattagaatattttgattttcattttctctcccaaattcctgagcacacatattaatcctgcttcaatgttttggaggatgaaggggattcaaaaataagttttggtactcataattaattgcaatgctctcccttttcctctttttttttctttttaaaatttacttttcttctttaaactttaccataagatcttgggattttttttttttttttttttttttttgcttctttcaagcaatgatagtggaagttctctgaactaatctccacttaagactcaccaaattagccaaagtcttcattctctttgtgaaacagcagtgatgggaacctctcacagcctcaataaaatgttcgaggtgcctgtcagtatgtgtggaccttctgctcccatcagttgacttgttacaaccgtcagttgtgtgtatgttctcaaacctatctttgccagtaactgttgtgattatgtaatttaataaagaaagatttcctaaatcataaaaatattagtttaaaaagaaaagaaaaaagttattatttctataaaaaccaggccaaatactctggagagttgcttcaaaaagaaaaagaaaataaatattgttgaagtagttgtgaacaagacaactgctaaagatgaagaaaacaacccagaccaggtggggtggctcaagactgtaatcccagcactttgggaggctgaggtgggtggatgggtggatcacttgaggtcagcagttcgagaccagactggccaacatggtgaaaccctgtctctactaaagatacaaaaattattcgggcgtggtggcacatgcctgtagtaccagctactcagggggctgaggcatgagaagcgcttgaacctgggaggtggaggttgcagtgagccaagatggcaccactgcactcactccagcctgggtgacccagcaagactctgtctccaaaaaaaaaaaaaaaaaaaaaagaaaaaatgccaaatattcagtttaatctgaattcctaaatttctgttaaaatatttgacaatggaagctttgactggtgtgaggtcagttgataaacagataactgggggcaaaggttcactttggggaagtctctagatggggttgagcagactaaaggacttcagtcagctagaaatcatcatgagggcactcaacgcatgaaggtggaagaaaggagataacagatggtaggaaagataaaaaggaaaaggaggcaggagaatgctcatgtcagtcttcactttggcatttgatttaggttttggtagcagcttttaccacccaaggatggctcaccactgtgggctctcagtgcccagcagcatacataacaagaagtatggccgcctaaacacagagtcacaagaccttcaccctgtaaagggtgaacacaggtactttgctatttaaatagatgtgacattggtttggctatatttcacagattagagcttttaatatgacacacataaatttgtgtttaaattattaaacactacacctaaaatgtcaaaaagcacagttaacgctgagcaatacgaggtgctatttaagtgatatcaggattgcattaggttttttttctagtttggaagcagtaagtgagaaaacattgaagaaagccattatattgtgggttttctttgaatcacttaaacatctggaatatgttctccatgaaagagcaaaccaagtctaattttattatgactagtttctcacaggcagaattttcagttcattaaatgttgtctgattatagatacaaaagtactgatttagaatgataggtaagtctgatataataagtttttcttcatataaaattaaattgcctgtcatatctttgcttatctttatgtagctaaggatttgttcaaatacacatttaaaattatagtcatctactacttttctaagaaaataaaggaattgtctattaacaagggaatcttatttttgagggaggaattttgacttgacagttaagagaacattcctactgcaaagcacagaaggtcagttggaaagactagaaagagtaaattgagggaattctgcttggaggggttttatttcctctgtgaagtaggaatcaacagacctggcatagtctgcagtgcctggcatagcgtgcagtgcctggtgtgcaatgaatagtcactgaatgaaaacatgaattaagggtaagtgggaacatttgaattaatcgtaatagagactgtgagagggagttgacctaagagatgtaatgaggttggcaaacagtgttgagggcccacttgaggatgaggttcaacattttttagcagaaccaatctgcctgactttctcattttctccaacagtgttgcatgtaagcatggggaaaacagttgatccaggtttggggtttcgtcagatgactgtggctcacacatttagggataagggagtttcgatattagccaggatgtaattgaaaaaatatactgtggaatctaaactggattaggaggaaagcaaagcaaaatgaagcttgtagatggagagaaagtagaggggtcagttgtagaagtccaggataatccataaaaggccacagcaggagtagctgcacaaacaagcgacagagaggggagactctgggatgctcagattagctctactggatttgccacttatgagtttatttataaatggtgtgatatatatatatatatatatatatatatatatatagatagatagatagatagaaatctggctatatatatataaatatatatagtgctactcagtgtttgaaaaacttcccttcttagggatattaaatattcctcctaaaatcttaacctgctaactcatagacgtcctatctcacttactaggaattcaaaattactaggttccaaaaatgaagtgttattcttgggctacatacacgtgcagagaaatttatgttacaaatattacttaagtagggactaatggcattgctgtctaccatgaatccttgtcaaacaaatgtttgttaaccaagactcttggaaaacagcctaaaaagaggaggtgctaggaaagaaaagtcccagcattcttcatgctgagctagtcatgagaaggcaaggatgagcaattagaaatcatgtcctataaatactggtgtttagtacttattccggggctcttcctcgtggttcagggaagccctcacagaatgcaattacccgggaattggcagcaggtacagcccagctatgttttgcagctcctgcatttctcagcagatatatcatcctcatggggccaagagagtcaaggactgtatcttgctttttccagaggatcagaggcctactggaatctctcaaatacctgggcggaatgagctactcaaatgctgttgaaacaattaaaaagaaacacaagttgagctgtaagcaagcccttcatgaaatgtatcaggctcagagacttccatcattatctgtaatttttgacttttcattctggttggttccctgactgctctgatgcccagaatgtaggtacagcttttctttcagatacctactgccttcagccaggtttaagagaagcagagtctgagtgctcttaagaaaaagggagtgagagaagcaggaagacagggcaagaaagttaagttgggatgtggtatgggctggagaccagcatcaatctggccccatgggaattcccagatcacaaattgtacaacagcaggtgccatgatgaggcaaaggggttttccctttgtacccctggtggttttaagagagaaggtgtggtgggacatgccagtcaaggtggcttccttttggctgagggaggttctctggaaaggggtgaaaccatgaggctttagcagctaatactcagagtcactgaggaatgggtgcaccaacccagtgaacgaatctgactggggcaccaacagcatccattacttagattaacttcatctgctttcccaatagcctttacccttgaacttcagttgtcaagcacttatattttgtttttttttttttttcaggagacttttcttttcttttcttccttccttccttcttttctttctttcctttttttatacaggagacttctttctttctttctttcttcctttctttttttcaagagacttctttctcttttttctttccttccttccttccttcctttccttcctttctttcctttttttttttttttttccaaggtggagtttcactcttgctgcccaggctggagtacaatggcacgatctcggctcactgcaacttctacctcctgggttcaagtgattctcctgcctcagcctcctgagtagctgggattacaggtgcccgccaccacgcctggctaattttgtatttttagaagagatggggtttcaccatgttggccaggctggtcttgaactcttgacctcaggtgatccacccacgtaggcctcccaaagtgctgggattacaggcctgagccaccgtgccgggcctgcaggagacttcttaagtgaattttcattactaacactatggggctatttcatagctctccaacaaaactgggattgtcaccctttctcgaaagttgagtccctcatttctgccaaattctgagggactgtgtggagctaagacaaaggggatactttgcagactgagcgaatacaaccctctgcctttagtatcacttatgcttctggtagagacattctcgacaataaattatgccattgaaacgtactttaaaaaaaaaaaagggatgtgattgcatttttttccagcaacagtttttattgtgatagcctgaaggcaaaatattatgcagtttcttttcgttgtctccttccgttcagttttcagggcaattcttgtaaactttcatatttgggcatgatcacttttgacgagtaaactgaataacaatataaataatgaaacagactcagaactaatggcctagatttagcataatcagaaacacttaagaaaggttaaagtcaaaaaaaagatcttgggaaaacaatattaagtttgtaggcatgaagaaatttagggcttttatttcccaagcgattatcagtaattatattttaactatggtttcttctcagactcaacacgcttccaaatttgtgacattaaaaaaatagcaattaactgctctgtgttttccataaagaatccacatctttttataaaaaacaatctcaaccaggtgcggtggctcacgcctgtaatcctagcactttgggaggctgaggtgggtggatcacctgaggtcaggagttacagacgagcctggccaacacagtgaaaccctgtctctactaaaaacagaaaaattagccgggcatggtggtgcacacctgtaatcccagccactctggaggctgaggcaggagaattgcttgaacccgggaggtggaggttgcagtgagctgagattgcaacattgcactccagcctgggcaacaagagcaaaactctgtctcaaaaacaagaacaaaaaactctagtttctctttacaatatcgaaaaagaatatatacccaaacataaaaggataactttttctttttaacattttctctttgcactgatcataattcttcatcttttaggacatggctttctatgaagcttgtaactccaatgttcttataataaaagccgaattatatcttggccatattaacagtgtctatcttctttcttttctgggtgctcacatttccttcatgtataaaatttggaaatgaggaacagggaagtattgaccacaaaggaaaagtttttatttttaagaacaagttgaacatagcaggagcaattgatattttgcaaaccatacacccggtaaggggtcagtattcaaaatacacaaggaactcctacaactcaatagcaagaaaacaaatcacctgactaaaaaatgagcaagtaacctgaatagacatttctccaaagaagatatagaaatgagtattcagatttatagacaggaaatagaatggtggtttccaggggctgggggcaggaagcaatggggaattactgtggttttttcttttttgttccttttgagatggagtctcgctctgttgcccaggctggagtgcagtggtgtgatctcgatctcagctcactgcaacctccgcctcccaggttcaagcaattctgctgcctcagcctcccaagtagctgggattacaggtgtgcaccaccacgcccagctaatttttgtatttttagtagagatggggttttaccatgttggccaggctggtctcgaactcctggcctcaggtgatccgcctgccttggcctcccaaagtgttgagattacaggtgtgagccaccatgcctggtggggattatcgttgaatagacatagagtttcagttttgcaagatgagaagagttctggagatggatggtggtgatggcagcagaacaacgtaaatgtatgtaatgccatggaagtatacatttaaatagagccaagatagtaaacttcatgtaatttgtattttaccactatttaaaaaatcaaaaataagtacaatttgtaaaagaagaaacttgaacaaattttattaatttccttgggaaaatgtttctataatcctaactgcaactgccagttatctcccctttatagacaaaaaacaagcaaaaaaaaaaaaaaaaaaaaaaaaaccacaaaatacttcaagctttccaatgacacaattaaaacaaataaaaagatagttcatgagtgtttcacagaggctaaatacaaaatatacacaattaacacaaaaaggcttttaatgagcacaaataagtcatttaagcaggtcatgctttaggttgctaaggaaacagaaaaaataccaatattttctgtctgaaaaattttaattatatgtgacaaaatgaagcaaaatggcagttaatgaaacctattaacttccttaaaagtaagtaataatccataaaccattaaaatatcaaccatgaggatgtttatcttcaaattcagaagttacttcagacagatgaagttttactttttttttgagatagagttttgctcttgtcgccccggctggagtgcaatggtgcgatctgggctcactgcaacctccgcctcgtgggttcaagcgattctcctgcttcaacctcccaagtagctgggattacaggcgcacaccaccaccatgcctggctaatttttctatttttactagagactgggtttcaccttgttggccaggctggtcttgaactcctgacatcagatgatccacccgcctcggcctcccaaagtgctgggattacaggcgtgagccactgcgcctgaagttttacatttaacaagtttttgggcttgcaatcatttcttggtctgagccacatgtgttaaccaccattgtccctgaatgggccctctccctcccctaaatagctcaaaacatcagtctaaggcagtgattctcacacaatagtgtgcatctcattgtcatgtggaaggcttgttaacacagagactgctgagtcccacttagtgcttttgattcagtgggtgtaaggtgggcctgagaatttggcatttctaataagaagttagaaaatgttgagttcctagaactcatcaagctttttatttctttatttatttttattttatttttcagacagggcctctttctgtcgcccaggctggagtgcagcagtgcgatcatagctcactgcagcctcaaactcctgggctcaagcgatcctcctgcttcagcctcccaagttagccaggactacaagcacacaccactggcattgatatatatatatttttaagttagttttttctttttcttttttttttttttttttgcgagatgggatctctctatgttttccaggctggtctcaaactcctgggctcaagtgatcctcccacttcggcctcccaaagtgttgggattacaagcatgagccaccgtgcctggcccaagcttactcttgacttagaaccttcagatacactgttccctctgcttggagttttatatatccactttatgcctagctggctcttattcatatacttctgatctcagttagatgtgacttttaaagatagcctattcccagttggttgccctacgtaaagtgtctcctttttccttgactctcaacaccctattttccttctgaaccctgatcacaatttgcaagtacatatatatttgcctattcatttattcattgtctgttccttcccaagaccagaaaatttattaaggcaatcctacattattgtttttcaccagtatatgccaagccatagtacatgataatccctcaatacatttttattaaagaacaagcagtcaagagaattaggcacttctgtactaattactaatacttcagaccaatagctattgtcagactgcttcgtaaacagtttctcacagaaacctgacatagagttcctaaataagagaaagctacccattttccttatcccatatctgaattatttatatctatcacttgatttatattggagcatttgctaatttctgaagcatctctcattctttgggcaagaatataacatttcagtttttggtctctaccagggatttttaaaataaaaatggagtgagtgggaaaaaaagaggaagtagcctattcaaggaaaatatattctgcttggtggtggtggcacaagttagtgcatcttttggagggcattttaacaacactgaataaaagcattaaaaatatttacatatgaaaagactagaagactacaaaccaactgaaatccagcctgggctctactaccaaattggttaggcttggcataggaccggggatctcttcaaaaacacagtgcctttttcttctttgcccaaagaggcccttgcagggattgggattatagatgctggggctgagattacagatgatccctctctctctctctctctctctccctgcctccctaatttttgggcttttccactaaagaaaagttacttaaataatgatatgaactaagaagtcatcaaatattagactgtaacgaagttcatttacaaatattttccacttgtgtagaaaagggatagtaacatgcatactttagggctgttacaaagatggatgagaagtttaggcatatttctccttcttttagttcacatatagtcacacaagttcctattcaggctagtccagggagactctgcaaagcagtaggtaataagttcatccatgagagagtcacagactaagatcctttgccgggtagctacctttttggagctgatttctcacatcgccccaggggcaacctctatcatgtagccttataaacgtctcctcgaactagacattggaaagtaggtacatgaaactgataaagaggaagcatagtgtggggaagaaagatatgtgttcagaacttgaacaaagggtaagaggtaggaaagtttaatgtgtgtctgaggaaaagcaaatagcctttaataacttaaaatatgaagtacagggcagctgtaaaagatgaatcatgggtgttttctgggatcaagattgtggtgggtcttgaatgaggtggcctttacaatgtagaatgaagatgtccacaaaacgggaatggcattttctcggcaactcttagatttaattactactcacttgaaaacacttactttatatccactagatactgtgcccacatatatgtgtgtgtgtgtgtgtgtgtgtgtgtgtgtgtgtgtgtgtatatatatatatattatatacctatcatccactggaaaaatggaagtctcaacacactcacaatcattagcagaggtacacaatttaatgggtcattaaaaaaaatgcaatccatattatgagaagttgagtcataggggtttggaaggtgcagagaaagatgctgatggaggggaagagagacctcctgagtagataaggtgactgaaatcattcacagaggggaacactagaagaggcatgttcctctggacatgaaatagtcacctggaaaatctcaagtagatcagtataacttgtggtcattgtggaaaggagaagagacacagagtgtttgtatgcagagacaagaagtaacaatggccagaaataagctggtggcaaatggagcaaattatttgcaaaataatttttaagggtcacgctatctaaaagatagcattttgccctatgcttttgcacaaatttgtttattcatttattccaaaaactattattgggtacctattatatgccagggaatgttctaggcactggaaatacagcgtaagatagaccaagtctctgtaatcatgcagcttaaggctaatggatatcatttcatttaaatgatgactattaataactaggcttataaagaagcaaattccaagccaaaatatatcatggctataaaatacaatttttgaccaagaaaatgcaggacaaagtataatattgcagatagcagtctcaaagagattctgttttcacttattaaagcaaattaagctacctctgcatgtctgaataatgattaatagaggaatctagaattgtgagttacccgtgcaatatgctgtacctggtttgctttatatggagcacatttatttagttttggttctagggggaaggcactcactactgaaacaaaatggatttttactgatttgatttttcattcaatatattattaacttagaaatactaaggcagaaatgaaccaaagattaatacaaatttttaagagcagtgataaaaataatacacagaagagggctaaaaaggattgcaaaaacgtcctttaatatccaattttactttcagattattgtagttcctaaatgtaattaatgtttttagcctttctaaaatggtcttatttcttgcaaacaaaataaaaaagcaggatgttcaactacttaaagtcaaacgaaaggaacagaaaacgaattttcttcattaaaatctatgcaacatcataatggttcatcttcttttcatcatattctgaggctgaaaagaaagtcttatgtattcatttctgagcaatgtgggccctctggacacattattagttgttatttttacttctgtgaatacatgaggttgtgaaaagtctagcttcttgagtcaagagtttattcagtttgtcatttttctcaccataaaattgatattttcaagatattattctgatttttatgatcacatcttaaggtaatatctaaattcatatcctgtaatagtctgttatgacaactgctatcatgataatgtccagttaagtacatgcaaatgatgaataaattactacttacacaaatgagtctaagtgtcaagctgtctaaacaacgttctcagatgtgatttccaaaaaaaaaaaaaaaaaaaaatcactcattggccaaatctaccctttagaaaaagtgattgatattcaactaacagatatatttaatagtaatagacttttttctttttcaaaataggagtatgatttagtgccctcaaaaatctgtgggggtgatgctgcattgattatctaaaggagaatacaatttcagtaggaaaaagagttcaaaactctttttaaaataatcttttcactaataattcagtaattttagattcaaagtgggtcagatttcaccaagacccctcttgcatacaacaatcaaccccaaaccctaggcagttttataggagaaacgactttgcaaatgtcttccttcaacctttatacaaaaaaaaaattgagatggttccaaaggtaatattttattcacagcataagccaacggagtaatttatgctcatttgtttagcctgtatttcttttaaccttatgctttattggatgcacaaaagtcaccctgatattggataacctttgtggagattctagtatattgggtttgtgaaagtctaaaacaatggaccattctctcccttgctttagccccatccctgctagaaacatgtgaagaccaaaaaccaactggcaagcagaaggtgaagcaggtaaaatgccgttgcatacagtctgcttgcttgggggcagataagaaacttaaatcacaggtcagttaaatgggtattatttaataagacctaataggctttaggttcacaacaatggatagatctcaaaatgggttacaatgttttaagagtaggaaaaaagtaaatgaaaggaaactcagcagtagtttatcattggttctaaaaaaaacacatcaatgtattgccaaagactctcattcacttttgtttctacttaattcctgtacttcggcatatattgccaataaattgacttcactctgttcactaacttgcttatgccgtgttaagatcatgatgatagaatgtgaatatttgatagggaaaagttctaaatgagtcatttgagtctataatgatgcataatcccggaaaaccaaacttctaaaaataagtgtgtttcgaaacaggactggcaggttcttaactttatgaagaaaaaaaattaccataaaaatcaattccttaaaagaaaatagaaatctgtcttagtgttagatcctccagcctcattctggttaagagaatttggcgtttcagggctgagcacactgtggaaacttaataaatattgaggtttacaaacaaaaagcataacaatgatatgtggaccaattttcaacaacactgaaaatcaatgtgcccttactctgcctaattcagttaactcaattatttaatgtacacttgatttgagtgggtttgaccatagctatttccattttccattgaacattaatcaaattgcttctaatgtaaaatttcattttttctcatccttctcctctcccagattctaggataagggaaaagtttaagtttcatgtctcttgtttaaagttaaaagcaaattttaagacatctgtttccattagtttatcccataattctcttttcatataccactcaccctataccacaaccatgaactttttcacagatatttaatacattgttttttgcaccattttgggaaaaatcctccttcctcaaccacttcagctaagactcttttctactttctcccagttgatcccacatcatctctatttcatctctatttcacctcatctctatttctatacacaaaaatataccctccccctgaacacagagcctcaaggggtggacaaagtaagttataaaatgtaggcactcctggagaagctgttagctattcatatctagcaagtagattttacttaaaaagtgttgactgatcccaactatttttaatatcctagattcagaaactctataaagtactattttatcatcagtatgtttggtagaaaagtgtaaggagaatttttaaatgtaattgtttttattggtaaatgcaaaaaatatttacacaaagtgaaaagttatgtgactaaatatatatatagtttgagacaaggtcttgctttgtcactcagcctggagtacagtggagtgaacagggcacactgcagcctcaacctcctgtgctcaaacagtcctcctgccccagcctttcgggtagctgggactacagacacatgccaccacacctggttaatttttgtattttttgtccaaacgaggtttcactatgttgtccaggctggtcttaaactcctgagctcatgcaacccacccacctcggcctcccaaagtgctgggattacaggcgtgagccaccacggccggccatgactaaatatttttaacgttaaaaattaatactgggaaggcaagttatgctgttggtcatctgaagcaaccccaaaattgtaccagtgtcattaaaataccaacaggaaaaaatgaaataaaccaccgtcaaagtcttccacaagtgagatttagaaaagaagccatttattcatttcaaggttcctaagcgaaacaatgctccctatgatgctcccatatctaaactattaatcaatccaacaagaggctgtgtgcctgcattcatttttaaactaaatcttctggatattgataaatataaaagaaataataaatgatatatttattacttgtaattgaagaaacgctaacactacacaaaatatgtcttcaggtacatacacagtagctttactatggaatattggttctcagaatgtatctctgaaccagcagcatcatgaacacctgggaacaagttgggacttcttagccttgccccagacattttgaatcaggaactctggggaaggggttcaccaacctgagtttctacaagccctccaggtgattctgatgtatgctgaggtgagaaccattgccactgaaaattcttgacattctcaatgatgtctggacatgtctgaatgcctagacatttacagattccataactataaagccaaactcacttatgaggccattttcttactaatagtgatcactttcttagactttttcattcattaactcttctcttccatcactaattctgatgaacagctatcaagctattcatggtagggtggagggtaggtggattttccataaagaaacaaaattctcattatttataaagaattactgtacatgcaaaaacaaaacagcattaaaaaaagccaagttgaatatgaagagtgagtggattactaggtttacttattagttgcaggggacactttacctaacctgggcatccatccttcagctgctgtgatggttgactattaatgtcttatagctacctgccttctccacatgtgacctctgcttatgggagccccctagcccaggaagtaacccatatcccaggagtggaccacagccagtggtgtgctgcagcagagcccaagagccaattgtgtgcatctcctcccaattccatactcagtggcattatgtcggtagctggagatcagtggtagagggagtatttacaccacgaaaactggttttgatacacaccaggattcatcccacctcagagctagtcgacaaatatttgccagcacttcagtgacacagacaatgactggtataaaggcacaactccggctcggtgttgtggcttacgcctgtaatcccagcactttgggaggctgaggtgggcagatcacctgaggtcaggagttcaagaccagcctgactaacatggtgaaaccccatctctactaaaaacacaaaaattagccaggcgtggcggtgcatgcctgtaatcccagctactcaggaggctgaggcaggagaatcacttgaacctgggaggcggaggttgcagtgagctgagattgcactccagcctgggcaacaagagcgaaactccatctcaaaaaaataaaataaaataaagagtacaactccacagcgaggtttctgctcgagggcttgctctctctctggatcagacacaatgtgaggtttcacctgaaatggcatacttgctgggctctttcttctcctgtattgtttccctaactccaatacaggcttctcctgagagcagaccctctataaatcacaggcacctagacccctgttctcagggtctgcgttcatggaacctgacttaaaatgccatttaactcattagttaagtgactatgcacaaaagcttgaaataatacatgttcaaaattaagagctgctagtcatggaactttggatcacaataatcagatgaacctgcaaaagataaatttgaaatagcaagggtctgctctttttgtctgtgtacataaaagacagaagttgatggaaaaagataaagcctgcaaaaactgggcaatcctttatactgtgattctcaacttacgctttcatgtccataggtgaatgtgctgaaagattccttacttcagaatttgaagaaaaagcatcttcatattaaaacatgatgaatccattatggaaaataccataaaattgatgtgagatttaaaaaataaaacaagaacatcaaagaaatttcatgctcatggaaaaaggagataggtaagtggaagcgggagatgtcaggctatgtcttctatgctgttaagataactgaagtaaataagtttaagaatcactgctctcggaagatgcttttaaatagaaaaacctgcagtaagtgtaaactataactaaaaatattattttaacatgaaaaaatcttattatgaaaaagttctttcttaggccccattaaaatgagagagacattagtatcacagacacaactgttcccataatacccagaaaactgatttaccaagaaaaattattcaatgccattacttaacttagttaatttcaggttgtgtaaggcataatactggtgtcaatgctaactgttaaattttgaaaattgtaattgtcaagcatgacaggaagaagcgaactccttgggttatttgatcttaaagcatttcctgttttactgaacggtaggagagtaacagaattgtgaactttattcttgtcacaactttggtagatgtcaaaaaataattaaaaatatatattggctgtgtgattccattttcttaggaaatatggaatttcagttaaataaataactcacattttagcactgtttctagttaatgtggtacatgcacatgtatacacaagctaatacaaattcttgctccctcagcttggtgctaaataataatattcccaggaaaactaagatgccatctatacaactctcaatataatttttgtttttgaaataaattaaatgttcacactctataatgagatcagacttctctgggtataggtttcaatcatatcatgaattaatgaatgagtgcatttgtatatcctctaatactgagagtatattacttaagttttttgaataatcttttattacccgagactcttgaggaatagtatttctagttattacccaccacaaacaaagctttcagaaaatcctagcaaacaggattggcatattataggatcagatgttgatatggttgttttcaaatagtaggaaggatggtattatttggagaaatttttattatctgattaaacacttcttgagtagaatcagatgaactcattagctgaacattttgattacccgtgttctcctaaatatcccatgaccagaagagtagctgtacaactctgatttaatccaataacaataataaccaattctagctccttcttttatcacagtccatcaaaataacacaaagaagtccaaattaaaataagttcaatgacaaaaagaacatgttccttttccaactgttctaaagccttttcctgtctttaagcaaagttcattcagtcattatctcatctatgaaagtaaaagcagaaggatgtttcccttattaaataaatggctttatgctttcgatgtggaaggcatttcataacagtcaaaaaaggaagcgttttgaatgccatcaactcatttcctcccacccactgttttaaatcgtttgtttggttccaatgtatactacacttacataagttgtttatgaagagccaaattaatagtctttgcaattgtttttgttggaatttggagagctgacaagtgaattagtagaaaatggcaattctacatgaattagcttttaagtctccctaagaggctgatgcagaacttaataagagacttattaggagaagtaggacaacttaattcagattgattatagacttcggtgaagacagctggggttcaaatgaaactgaaaaagaacttatatgcacttcaaagtatgctaagcagatgtctgaaacaattactccgctctgccttttcagaagtttcaaaggcgggatgggaatagcatggtaaacgaaggttctgtttgcctaagtcgaggtaggggcttttaaaacacacacagcgctatctaaaatcagatgctttggggaaagaaagtgatttgacattgctgtcctaagtaatttgcttttagctttataaacaaagcaggagatgagagggaatacatggtaactaagtaataagctctcctggcaacactaacttacaattaatttcacattgaataaataatttggtcaggattttttttttattattattatactttaagttctgggatacatgtgcagaacgtgcaggtttgttacataggtatacacatgccatggtggtttgctgcacccatcaacctgtcatctacattaggtatttctcttactgctatccctcccctaacctcccacccctcgacaggccccggtgtgtgatgttcccgtccctgtgtccatgggctctcgttgttcaactcccacttacgagtgagaacatgcggtgcctggttttctgttcctgtgttagtttgctgagattgatggcttccagcttcatccatgtccctgccaaggacatgaactcatcctttcttatggctgcatagtattccatggtgtatctgtgccacgttttctttatccagtctatcattgatgagcatttgggttggttccaagtctttgctattgtgaacagtgctgcaacaaacatacatgtgcatgtgtctttatagtagaatgatttataatcctttgggtatataaccagtaatgggattgctggatcaaatggtacttctggttctagatccttgaggaattgccacactgtcttccacaatggttgaactaatttacactcccaccaacagtgtaaaagcacacctatttctccacatcttccccagcacctgatgtttcctgactttttaatgatcgccattgtaactggtgtgttttgatttgcatttctctaatcaccagtgatgatgagctttttttcatgtttgttggccgcataaatgtcttactttgagaagtgtctgttcatatcctttgcccaatttttgattaggttttttcttgtaaatttgtttaagttccttgtagattctggatatcagccctttgtcagatgaatagatggcaaacattttctcccattctgtaggttgcttgttcactctgatgatagtttcttttgctgtgcagaagctctttagtttaattagattccatttgtcaattttggcttttgttgccattgcttttggtgttttagtcgtgaagtctttgcccatgcctatatcctgaatggtattgcctaggttttcttctagggtttttatggttttaggttttatgtttaagtcttgagttaatttttgtataaggtgtaaggaaggggtccagtttcagttttctgtagatggctagccggtttacccagcaccatttactgaatagggaatcctttctccattgcttgtttttgtcaggtttgtcaaagatcagatggttgtagatgtgtggcattatttctgaggcctctgttccattggtctatatatctgttttggtaccaataccatactgttttggttactgaagccttgtagtatagtttgaagtcaggtagcatgatgcctccagctttgttctttttgcttaggattgacttggctatgtgggctcttttttggttccatatgaaatttaaagtagtttttctaattatgtgaagaaagtcaatggtagcttgatggagactgcattgaatctataaattactttggacagtatggccattttcacgatattgattcttcctatccatgagcatggaatgttcttccatttgtttgtggtgtcctctctcatttccttgagcagtggtttgtagttctccttgaagaggtctttcacatcccttctaagttgtattcctaggtattttattctctttgaagcaattgtgaatgggaattcactcatgatttggcactctctttgtctattattggcgtataggaatgcttactatttttccacattgattttgtatcctgagactttgctgaagttgcttatcagcttaagaagattttgggttgagacgatggggttttctaaatatacaatcatgtcagctgcaaacagagacaatctgacttcctctcttcctatttgaataccctttatttctttcccttgcctgattgtcctggccaaaacttccaatattatgttgaatacgagtggtgggagagggcatccttgtcttgtgccggtttttaaagggagtgcttccagcttttgcccattcagtatgataatggctgtgggtttgtcataagtagctcttattattttgagatacgttccatcagtacctaatttattgagagtttttagcatgaaggggtgttgaattttattgaaggccttttccgcttctattgagataatcatgtggtttttgtcattggttctgtttaagtgatggattatgtttattgatttctgtatgttgaaccagcctggcatcccagggatgaagccaacttgatcatgctggataagctttttcatgtgctgctggattcggtttgccagtattttattgaggattttcgcattgatgttcatcagggatattggcctgaaattttctttgtctgttgtgtctctgccaggttttggtatcaggatgatgctggcctcataaaaagagttagggaggagtccctcttttcctattgtttagaatagtttcagaaggaatggtaccagctcctctttgtacctctggtagaattcagctgtgaatccatctgttcctgggctttttttggttggtaggctattaattactgcctcaatttcagaactcgttattggtctattcagggattcgatttcttcctggtttagtcttgggagggtgtatgtgtccagaaattaatcaatttcttctagattttctagtttatttgcgtagaggtgtttatagtattctctgatggtagtttgtatttctgtgggatgagagctaatatcccctttatcattttttcttgtgtctgtctgattcttctctcttttcttctttattagtctggctagcagtctatctattttgttaatcttttcaaaaaaccagcccctggcttcattgattttttgaaggatttctcatgtctctatctccttcagttctgctctgatcgtagttatttcttctcttctgctagctttggaatttgtttgctcttgcttctctacttcttttaattgtgatgttaaggtgtcaattttagatatttcctgctttctcctgtggggattttaatgctgtaaatttccctctaaatactgctttagctgtgtcccagagattctggtccgttgtgtatttattctcattggtttgaaagaacttattcatttctgccttaatttccttatttatccagcagtcattcaggagcaggttgctcagtttccatgtagttgtgtggttttgagtgagtttcttaatcctgagttctaatttgattgtactgtggtctgagagactcttatgatttctgtttttttgcatttgctgaggagtgttttacttccaattatgtggtcaattttataataagtgtgatgtggtgctgagaataatgtatattctgttgatttggggtggggagttctgtagatgtctattaagtccacttggtccagagctgagtttaagtcctgaatatccttgttaattttctgtttcgttgatccgtctaatattgacagtggggtgttaaaatctcccactattattgtatgggcatctatgtctctttgtaggtctctaagaacttactttatgaatccgggtgctcctatattgggtgcatatatatttaggatagttagctcttcttgttgcattgatcactttaccattatgtaataccattttttttgtcctttttgatctttattggtttaaagtctgttttgtctgagactaggattgcaacccctgctttttttttctttccatttgctgcttggtaaatattcatcgatccctttattttgagcctatgtgtgtctctgcacatgaggtgggtcttctgaatacagcacactgatgggtcttgagtctttatccaatttgccagtctgtgtcttttaattggggcatttagcctgtttacatttaaggttaatattgttatgtgtgaatttgatcctgtcattatgatgctagctggttactttgcccgttagttgatgcagtttcttcatagtgtgatggtctttacaatttgttatgtttttaccatggctggtaccagtttttcctttccatatttagtgcttccttcattagaagctcttgtaaggcaggcctggtggtgacaaaatctctcagcatttgcttgtctgtaaaggattttatttctactttgcttatgaagcttagtttggctggatatgaaattctgggttgaaaattcttttctttaagaatgttgaatattggcccccactctcttctggcttgtagggtttctgccaaatgatccgctgttagtctgatgggctttcctttggggtagcctgacctttctctctggctgcccttaacattttttccttcatttcaaccttggtgaatccgattattatgtgtcttgggttgctcttctcaaggagtatctttgtggtgttctccatatttcctgaatttgaatgttggcctgtcttgctaggttggggaagttctcctggataataacctgaagagtgttttccaacttggttccattctccccatcactttcaggtacaccaatcaaatgtaggtttggtcttttcacatcgtcccatatttcttgaaggctttgtttgttccttttcattcttttttcagtaatcttctcttcatgctttatttcattaagttgatcttcagtctctgatatcctttcttttgcttggtcgatttggctattgatacttgtgtatgcttcacaaagttctcgtgctgtgtttctcagctccttcaggtcatttatgttcctctctaaactggttattctagttagcaattcctctaaccttttttttaaggttcttagcttccttgcattgggttagaacacgctcctttagctcgtaagagtttgttattacccaccttctgaagcctacttccgtcaattcgtcaaactcattctccatccagttttgttcccttgctggagaggagttgtgatcatttggaggagaagaggcgttccggtttttggaattttcaggctttttgtgctggtttttcctcatcttcgtggatttatctacctttggtctttgatgttggtgaccttcagatggggtttttgtgtggacgtcctttttgttgatgttgatgctagcagtcaggaaccctctgctgcaggtctgctggaatttgctggaggtccactccagaccctgtttgcctgagtatcaccagcagaagctgcagaacagcaaagattgctgtctgttccttcctctggaagcttcatcccagaggggcacctgccagatgccagccagagctctcctgtatgagggtgtctgtcaacccctgctgggaggtgtctcccagtcaggaggcacgggggtcaggaccccacttgagaaggcagtctgtcccttagcagagctcgagtgctgtgctgggagatctgctgctctcttcagagccagcaggcaggaacgtttaagtctgctgatgctgcacccacagctgccccttccccgtggtgctctgtcccagggagatgggagttttatctataagcccctgactggggctgctgcctttctttcagagatgccctgcccagagagaaggaatctagagaggcaatctggctacagtggctttgccgagctgcggtgagctccgcccagttagaacttcttgacggctttgtttacactgtgaggggaaaactgcctactcaagcttcagtaatggcaggtgcccctccccacactaagcttgagtatcccaggtccacttcagactgctgtgctggcagcgagaatttcaagccagtggatcttagctggctgggctccgttgggggtgggatccactgagctagaccacttggctccctgacttcagtcccctttccaggggagtgaatggttctatctcgctggtgttccaggtgacgctgggatatgaaaaaaacgcctgcagctagctcggtgtctgcccaaacagctgcccaattttgtgcttgaaacccagggccctggtggcgtaggcacccgagggaatctcctggtctgcatgttgcggaggctgtgggaaaagcatagtgtctgggctggaatgctccgttcctcagggcacagtccctcacggcttctgttggctaggggagggaattccctgaccccttgtgcttccggggtgaggcgacatcccaccgtgcttctgcgccctctgtgggctgcacccactgtctaaccagtcccagtgagatgagccgggtactgcagttggaaatgcagaaatcacccaccttctgtgttgatctcactaggggctgcgcacctgagctgttcctattcagccatcttgccagccacttctttggtcaggattttaaagatgaataattcctgctttagtttctaagctgtattaaaccctagatattctattgaaaagctactgaaagtaaatcaatatatatgaattcacataatccataatcttacaatagcataaaatccttaatacagtactggtttagaaacccagtaacatctcttatcaccagtacataaacattctattaaaaatataccgtacttataaagtatggagtgacactcgctataatatggcctttgatagacatattttcagatattaaaggccaaatcatatgcttttaaacattgcaattgcatgctttgtaaactagataaaaccctggttactccaaataacaggaattagcttcatatttaacccagatttatgaaggattaaatattttttctttgttttttcttctccatcaaaggcttacttaatacacatagcatttttacaacaacaacaatgaaagcctccacacggcaattcatttgtagttctttaacaatgcacaaaacattaataaattttcctcttcctactataggcagtataccttattcattatgaagatatcacaagtttattcagagttgggagagcttacatgttttgaatgatttttaggatcgccctgttcatgttggttctatctgctcattcatcccctaattctataagaaaagataagttttccttacataactcatatataagaaatcaagtaaggttgacttgactcatataaatgggaagcataacaaaattaatacaataagaagaaaactttagaaccaaggttaagaagagaaaagcaataagggaagatagttgcatgaacatggttgcaagtatcttgcttgccaaagtgaagatgaaattctaatacattatatcacatttcacattatctattcagaggaaatatgcttggcttcctcaatgtcaaattctaacatagcgtttctttgacaaatttctcaaaaaaacccaaagccacagggactgaggatggtaagcctaaaaaggtggatttgccagttttcttcttaaaactttagatgtgaatgctgaagataaataaggatggcatcgtcacttcatcataatttctagcctactacacacatcattaaatcaatctcaatttgaatgccaaaaaaggtttaatcaaaacatttcattgtaggaactttaaagaaaaaactcatagaatccctgccctgacttttcacagtaagaaatgcaagttaaaagtttgacaaaaatgcgatatgcataactacatagatgcgacagatttgcatattccaagatggcagcctgggagagttatttacagtgtatgaaaaactgtgttcagagtcaacaggtaaactaagaacagtgaaatattcctggctcaagaaggacataccacttttggtacagagaaactatggtttatagtctgggcgcagtggctcacgcctgtaatcccagcactttgggaggccaaggtgaacggatcacctgaggtcagaagttcgagaccagcctggccaacgtggtgaaaccccatctctactaaaaaatccaaaaaaaaaaaaaaaattagccaggcgtggtggcacatgtctgtaatcccagctactcaggaggctgaggcagagaattgcttgaacccaggaggcggaggttgcagtgagccgagacagcaccactgcactccagcctgggtgacagagtgagactgtctcaaaaaaaaaaaaattaaaaaaagagaaaccatggtttattaaaacaaaaacaaaacattaaaaaacagcaatctggccgggagcggtggctcacgcctgtaatcccagcactttgggaggccaaggtgggcggatcacgagatcaagagatcaagaccatcctggccaacatggtgaaaccccgtctctactaaaattacaaaaatcagctgggcgtggtggtgcgcgcctgtagtcccagctactcaggaggctgaggcaggagaattgcttgaacccaggaggttcagcgagccgagatctcaccactgcactccagcctggtgacagagtgagactctgtctcaaaaaaaaaaaaaaaaagaaaacaacaatccacaaaccttttcaccttgggattgtcctgaagaacaaaaatcttgtatccagactacaggtttaaaagttattctactttattaaagcctttatatattccacttacagatctatgtggaacacctagtaattcaaaaagttattcctattccccattacaaggaaggtagaatatttgtctagtcaaataagcactggtgctattttcagtaaagtgaaaagtcatgatcttgcccttaaaatatttgataagcagtataaatcatgaattttaaaagtaaagaagcatttaaaacttaaatttgattctactgttttttcctatggaagctatgtttggaaggctgagattctcttagtgagcaatatagtcaatattaatattgtgtttccatttattaatttaccatgttcaccacccgcagatgatcagctagcaataatgccatttccataaaggccagggacttagtcattgttgtttcacccattctttaaatccaaaagccacatttgctaatacaattacagaatgctaaatctcacagaaacacatattacttagtttcttgaataacaagttatttaacacataagatcagaatggagggggggtactatgatagagtgtctaggggtaaggaaaatgaactgatatggatatataaaatgttcttctagctagctgcctagttatcagtgctgtaatccactttgggaggccaaggtgagtggatcacctgaggtcagaagttcgagactagcctggccaacatggtgaaaccccatctctactaaaaaatacaaaaaaaaaaaaatagctgggcatggtggtgggcgcctgtagtcccagctatttgggaggctgaggcggagaactgcttgagcccaggaggtggaggttgcagtgagccgagatagcaccactgcactccagcctgggtgacagagcgagactgtcgcaaaaaaaaaataaaataaaataaaataaaataaaataaaataaaataaaaaaagagaaaccatggtttattagaaaagttccctacagcatgaatcctctgagggcttaaattgctgagtggaaaaatgggaagagtggtttcaagtacacttctactttttttctgaaataaattttagttaataaaactcattctttgtaaactactacccccaaagcttcagagtttcaaacccagtgtcaataagatgcagtggagaaaaatgatttatttccactgcaaaattaaagaagagctaccgaagggagataaatatatatgaattcatgtaattcatagtttgaaacacgcataaaatacaacacagattcaaaagcccaatcacatctactattaccagtacataaaaattcagataagtaccataacttaagtgtatatatgtctgagaaagatagatgtgctgggttataaatataatttttcgaaaggtatgtttaatgtttatatgttttgctatcattgggatcagaatgagagttttaccaatcagggtatggaaaatgaagtttgtcttaagaccaagaacagataagacagggaaactaaaaggaataccgcaaatagggttgggtgaaggccagctgatacttgaactgttatgcttttagttatttttaattattaaattatgctgtacacattctcttctccatccatactcagtatcttacaaatgcacctgtgtgacaagtatggctaaaaatgaatcccttatgtctgctctacagcctatctattgagcaatttaattgacatattaactaatttagttccactgggacattttcctaacttatttctcatttttggagaagtctgtcaaaaaattagtccctatatttttgaataaaatcaacatatttaatgcttttaaaatactaggtaatacatttcaaaacccttagttttccagtacacagcaaggttaacccttactttaaatgttagacatggggtcataaaacattggggtagaagggattttacaagtattagagtcaaatttttaatcttttctttttaaaaattttacctactattttaatgaagagctatgcaattcaacattagaccataggcttcatgaaggcaatgatcaagtctgtttcttttataactacctgtccagcacattatataatgactcataaacagttgttgagtgaataaatgaaggtacctaatgagattcctcatatgttgctggccctgggctagcagcccaaagatgtacagcatgatccttgctcttagcaacttcactttctctgggagaaaaaaaaatgcataagcaagttgctacaatatatgtgaaatttaagtgtgacaatttagcatgcttggtgatctatgagagtaccaactgtaagcagtttcttctgcttggtgggagttgggggttgtagacactcaggaaagacaacaaagataggtaacattttggctggtccttgagggctgaaggagaattcgccaagtagacaacgtagggggatccagacagagagaacagcatttgcaaaggcagatatatctatatctatatctatgtgtatatatatgtgtatatctatgtatatatgtatatatactatgtatatatctaactatgtatgtgtgtgtgtgtatatatatatatatatatatatacacacacacacacacatactttacagacacacacattcaatacactctgcccatatcacccctttttcccaaatatgccatcacatatatatatatatcatatgggcagagtgtattaaatggtctggagaataggagctatggctgagaaggtaagtcaaggctaggaagaaaagggccacgtaatctccttattcattggatttcattctctaggcaagtattctcccgcaaggagtttggattggaattggaagaagctgggtaatgcaggaacatcagcaaagaaaccattcatccatccattaattcaccaaatgtttaaaatgcagtatctgagatatgccaggcacacagaggggtgaatgggatttaaagatgtatactgttatcatctaagtaaaagatgctggggattaaaaaggacattggttaaaagaggagagaaaacacaaaagagctattctgaggtaacatgagccatcatgtgccatcagtgaaaatgcagaagggtttaaggatgaacctaaagtttctagcctggaaaatttgttggatgatgattcattaactgaaataggaaacaggaaaaaaaaggtcagataagaggggacagaagtagggaaatggaaaacaggagaacaaatgaacttggtttcagaatagttgcatttgtgatcgtaatgccacatggattcagagatcagaagagagatgcggactagagatgtagatacatcaccatccaggccatctcaaacagggagggtttaaacaatcaaaagagaattaggctaaggttagaaacttgggcacaacagtatttgaggggtggctaggagaagaatctagaaaaatataggaagaagaacatggatggaacagttccatgaaagccaaggaagaggacaacttctagaatgaggatgctgagatgctggcaaacatgctgagtgcatgagggaatttaacttcttttgaattttaatctaggaggatttttgtgattttgacaatagatgagtagttgctgatttcaaaatgatactcctaaatatgtatttttttctacagaatatatttgccatctttgtgccacaagggaatttaactttggtcttatagacagtggtcttccaaatatataatgattttccctcatttctgcagtgggccaatgaaacttgaaactgtattacaaatgttgccttccaagggaagggcaacacattaacagccttatttcaccaaaccataacttacccaagtcatgtaatttggttagcaaaagggccaacacctagactcctggcttttgattaagtgttttatttttctgtattctgatactaagtaacacaagcaatacaccaatacacacacacacacacacacacacacacacacacatcagactttagtacaatcacttaatatcaaagtcaaagtgatttcttgccctgtaactgttttaatatttcatttcatataactgaagacagacaaataattagatcactgtcttctcttggagaaaataccatgtgaatgaagactgaatttgtgaaagacggactgatttctctagctttaactttgtgggaagataacactgcactcaagttcagattagaagctcttttgagtctctcaaagggccctgaagcaaagaagtagacggtaccttgactttctcgaggtgatcttggagagagtcaatgaggagatcgcccacgggctgccaggatcccttgatcacctcagcttggcgcagcttgaggtccagctcatccgtggcctcttgaagttcccggagtctttcaagggtctcatctatttttctctgccagtcagcggagtgcaggttcaatttttcccactcagtattgacctcctcagcctgctttcgtagaagccgagtgacattctgggctctctcctcaggaggcagctctaaattggcaatatgacaaggttttaggccacattctttttttttaaacattgtcaaaaaggtcatactggaagaaagaaagagtacagttgaacaagagggtaacctactgattaacggcttttttatactttggcataaattttgatacagcccagaacatctaaagtatatcttcctgagtttctaccttatatcaatccgacaatttaagattcacttaagctattgaggagaaaaacgttaggatgcataccacaagctctaatttacttcaggcaggctcttaaatggaaaattaacttgtagtctttgcaacaatagaattcctcctcacagataactccctttgtttattattttctaaatgttccaataactgattgctaatctcttttgatgtttatttatgaatgcacaaactgatttatgcatggtagtttatgagtccttatttttttttcagcatctatgtttaatttgaattgattctatttaaccaagaaaatatgagagctatccagaccctggcagcaagaatggatgggctgctccgtcaccactgatccttctatcaatatgttattatagttccacattcaattacctctgggctcctggtagagtttctctagtccttccaaaggctgctctgtcagaaatattcgtacagtctcaagagtactcatgattacaggttctttagttttcaattccctcttgaaggcctgtgaaatgagatgaaaagaagtgcttatttggcttgtggcattcttctcaaaattaatcctgggtgctcagaacttgtttatgaaactcccaggtcaatttctatctcttttatttatacactgatggttataaaatgattttttttaaaggctatatgggtctatctgttaatgaggaaagcgctgtgtttgtaaagctattctggggagatggggggagcattctggatagttaatgccctctcattgagataagagtgctttgtttatgtaacctgacagccatacttcaaatctacagctaaagtttcaaggtatatattgcaaaactctagcatggctaatgaggacttaaacataccccaaatagtggatatccagaacataatgggaagccttaagggccatttgcaggaccttaggctatattaaagtatacaatgaatccaactgacaatcaccagttaattctgtcaaaatgtctgacaaggtataaaataggtaagctaagagaaaagtctcaatacttttgaaaaatagtcattacatcatccattgtgacctctttgagaatagtagaaatgttttgagctattatggatgtaggaattgcggacactagtttctataaatgaacagatctagaattaatctttaatctgtaatcttcctttatccaggggatcaagagaaaaacaaaatgaatagtttctgccttcaaaaagtttctagatccaaagaagggagaaaattaacactagaagcagagtgaaaacagtaagttcacacataatcgagtgctaaaaggatcgtgaggtataccgtgagcctagaataacctaacggatactctgacaccattgaagagagttattgacccagattctttgatctcagaagtgagggtattaataaaagtattaagtgcatgctacataaatgctaatataactgtttaacaataacagtaatatttgccctgatctagggcttaatttttgtaacttttttcaactctgtcttttagcaatgttgcctgctgaatttaagccctgttctttcactggggaaaaacaaattagcagtattcttccttgaatttcagatatgccattatgttacagaagtgttccagagctgtattgtatgacacatttattaataaaatcttagcggtgttcaccattcaaaagaatcctgagtctgatactttgcaaaatgattcatcatccacagctatttacaattcaatagagaaagggaaggcgtttgaaccaaaatactggagttctgtaagtagaatattaggattcagcctacagatagggaagtactttctgaataatgggatatttctgtaccctaaaatcatgctagatacgtgagttatttactctgcttacatataaagctgattctcctgatatttcacttgaaatctccatgtttgtgtgtgtgtgtgtgtgtgtgtgtgtgtgtgtgtgtgtgtgttcagttgttgtattcttgtgttttttttcatacaattaagtttcccaaattcaagtaaattatcattttgcctagtttctctgtttggacctgaagggaggcaattaatactgacattactaattataaaaataataatggctccctctattgaactaccatgtgtcagtggttgtacctgaaactggaaatacaaagttgaatgcaaaacagccctttctatttaggaatatttaacatataatagaagagtcagacacgtaaataatttcaatacaatgtagacagtgctatagacttgcgcaatatggggaagaaaatcgggaaaagcttccaggagaagctagtaatcacatagaattcaaaagcatgaacatgacttattcaaggaagagtatgctagagaacattccaagaagaggaaaatgcaagtgcagagtcataggacatagtgcagtatggtatgtatcggaatctcaagcaggccagtgtttctagagcataaagaacaaggagagggcatgtccaaagatgaaaaagacactattgctatctggaaatacattagatttttaaaccagaatttgaagctctgcctctctatgatcacatatggtccactaagaggcttaggtgttgccttgaaggtaatcaggaacctttgaacggttttaaccaagggagtggcacaggaatatgtgtgcttcaaatagatcttcctgatataaatacagagtatgtatttgagaagaacagaaatggaatcagagagataatgaggcaattgtaagaattcagtgcaagattatgaggatttgactcagggcaatggtaccaggaaaaatgacagggataggatagggaaatgtctaaaaatctgaagtgtgaaaatttggtgactgaatagatgctggagagaagagagaaaaagaaacaagaatgacacttagtgtctaggttgagtagatgagcaaacgctgggtgcaattcaactaagtatgaggaaataaactttcctggatgtctcagttcacctacagaaagctctagcctcctgagaaacttcccacaccatggagattagatctgtagcaatttgtctagttcatttctctgatccaagagggtcaaacggttatagctcagggtaggttcctaagctgaactctatgttgttagaaagactggagtgggtatctttctaggtatttacatttcaaaaaatatgaagcccataccttggagacatttccagattgtaaaacatgagacacacagggctagctggtttctgcagaagctggaattaggactcaggcctgttatgtttccacagagaacctttcagaatgagagatggatagcagcctccttctcctttataagcagaaaaaatgatttttcctagtctcccacttatggagtacccagccactcaagtaggaaaatgtttcatcagcgttcatcatgttgccctaggggtaagtctttgggcaaaggaagggcacagcaacaatatttactgtaaggtaattaaatgaaatctgcctctgattcagaacccctcatgctcattcaggataaaattattgaagagtaatattaaaaatgcaacatgatggtgtgtgtgtgtgtgtgtggggggggtgttctgtgcatgggggacagagtaagggactgtgatatgctcagcttggaaagctaacattccttccacaaggaaataataaattctgaggtttgaggagaaaaaaaatacttaggagttattttctcattcagctaatatacgttgagtgcctacatatcaaagtttaatgggcaaacagaggaacaggatctcttgagagatagaaaaggaacaaataggtggagagattaggggaaatgaggagtgtagaaatttcaaggagagagtgagaattttgagaggaagagggtgaccaagtgagtccaatgaaacacagaagtaaagtaagatcagcattgcagagtgttcactagatgtgctgagagcaatttcagtggagggcagaagcctcagaagtaggcatagctgaggagtgagtggaagaaggagtaggtatttcaagtgaaaatcaaatgttcaattttctttttctgagaaggaaaagaggaagacacgacaggaggacagagaggataacaagacaaagggataagaagttctttttagcataggaatgatttgaacctagagtgaaagacggaagctagcagtagggtaaccaaccatcttggtttgtccagcattgagtttttcaggatgagagactttcgatgttaaaaccagaatagtttcaggaaaattggacagtctcaggaaaacgaggaaagttggtcaccctagatatatgttacgaccttgacagaaggtggagataattgttggaacaaggtctgtaaaataaggaaatggatcttttttttttttttttttttttttgagatggagtctcgctctgtcgcccaggctggagtgcagtggcgcaatctcggctcactgcaagctccacctcccaggttcatgccattctcctgcctcagcctcccgagtagctgggactacaggcgcccgccaccacgcccagctaattttttgtatttttagtagagacggggtttcaccgtgttagccaggatggtctccatctcccaacctcgtgatctgcccgccttggcctcccaaagtgctgggattacaggcgtgagccaccacgcccggccggaaatggatcttaaaggtctcatcaaacttaaaaacttaaggcactaaaaacttaaaaagtccaaggcactatttgatgatataattccattgttaaaactggacagtaaataattcaaagctaaggagcatccattgtgagagaccacgtgtttgcccatcgagttgttgccaaggacttagatccaccacagctgcacagttcatttcttaaatatgagtcattgaagattaaaatgaggccaaagaaaagacaaagaaagttctgttattacaaagacataagcaccattattttcacattgttgcctgaaattaagaaaagaaagtggatggaagagagggttaagtgattgtatctttagaatttcaaaagattcagattaaatacaaaaggataaaactcccacaaaaagagagaaatagttggttcaaggaggtcagaggttaaagaaaatggcaataattcttatcatgtgggaaaaactataaataacaatatgtaattttaaacatggttatatgtaagatcctctttaatttagtcacttaacaaacttcaagcaactactatgtatcagacactgttctaggcaatgaacatctgtggtctttgtagcatggagcttaaaacaaatggctttatgtagtaaaaaaaaagcaatgtagaatctgcattaaaataatggaaagccaatttttcagtatctaataactcaccataaactgcatgttgtagtataatttattgcattttaaaagaaagaaaaatgaagacttttttttaaaaaaagacaaacaagaatatttaatgtcaagagccttgattttgataagtgtcttgtctcccaaaaaggcctgtttgaaagaggtttgagaaaatatatactcatatatactgattttgtcatataaattttggttaatattttaaaccagagaagtcagttcctttatgtgatgatagaaaaggtatcagatatagatattttctcccatgtacatacagaatacgtatttacaatattcagatgttagcattcagatgttaagataattacttcctgaatcccttgaacagataaaattatctttgttaaaacacatcctcttccccatacctttcttttcacctttccaagacagccagacccaagggtccaaaatagtgatatgagagaattagaagcaatactaaagacgtagagcacctctatgaaaataaaatatgcaatttagaaaatgttaggaatactacacagatgtttgtccttgagcttcttaaggttcacaaaataaacttatatgaagtatgctactacactattatagcaatgataatctcaagataaatctatttattatgaaggttgaattatctggtagattgcacttaaaacaccataggtactggccaaccgggtgactgattgttgactcactaatttgttcattcaaaaaatatttattttgaacctattaggtacaaagttaggaaagatatagagacttaatctttgtcattaaggagccaatagtttggttgagtaggtatatttgtggtgtatacttttatattatgaatgtttcatccatgcaaattgagatacagataagttagggtttacctaaggccatcagttaattacacactttgaatctaaatcttgcaattctaaagtgaagctgaaagtgagtgataacaaaacataaaatctccctgacttagaataatttggaagccacataagtggaaaatcctaatggccatggaagaaatcagaaacttaaaaaattcctgaaagtaatagagaagaaccaagttattgattattattatttttatttatttatttatttatttttgagacggagtctcgctctgtcacccagtctggagtgcagtggcacgatctcggcttactgcaacctctgcctcctgggttcaagtgattctcctgcctcagcctcctgagtagatgggactacaggcacgcgccaccacaccctgctaattttttgtatttttagtagagacggggtttcactatgttgggcaagctggtctcaaactcctgacctcaggtgatccgtttgcctcggcctcgcaaagtgctgggattacaagtgtgagccaccacacctggccactgattatttttttctgtccctcttgcttcctgcttatattataaaaatatctaaataatgccataaatagaagtagctcagaaccacgtatggaggggatgaaaggtgagatattgatttgcttcatgagaggaacaagaggagaactctgggcataggtaatgacatgacagggagaaaagctatcttgctttctcctggggacagtggatttaggatcatattactatggatgtgagtaaaagcccgtgcttttcaaaacacagatgtctttcaatcatgtacagcttgcctggcgctgaattttacctgtattcatattgaaatggtaaatttgtgtttttcagaataaaatctgatggaatgactagaaatactacccatatttgtaagcagaacttcctagaatcatcctgggaggcaggctgaagtggtgaaaagagcactgttctgagtggcagaagccttgggcttcaagcctgggctgggccagaacctggctgcagtgatccagaaaaggtgataaactcttcctgctcctctgtgtcctcatttgtaaaatgtgggcatttgctaaaaccttatctaagttctaacatccagttctcatatactataatcaatttgttaagatcattaatcggccacaggcctgctctatggtggcagtttgagagtctctgctaagcatcgttattatcgatgcttaaaaaccatagccatagcttggcatatagtaaatgctcagtaaacattgttgactaagatacagaacacccagttagaacactagagtgtgttatatgaaggccaagttgatttagatgcaaaacaggcttgcaggggaaagcctggactcatgaatcataagtgaaaaaattaatgctgtaaattgggaaaaatggacagatcttattctaggtctactcatgttccagatccaaagctgagtgtcactgctgagttactgggtggaatttcctcaagaagtggtcccattagcattgccttcttcaacctagtgatttcttaaaggagattttcatgtccaaacactcagaagttccatggtttgaactgctgcttggggctttttctgtagtctgcaggattaggtaggagatgagaggacactagacaggctctgaaatgtaggatgatccaacagttctgttcattcaacaaatggataccgagcaggcatagaacaagatgttaacagtcatatctgtaacttgatctgtatttactagttttgccatcctacgtcatcattcttgttcctgtgttatttctaccttattttttatgtctcctgtattgtttctatgtctgacaagaaagttgctgaatatattctgtcaccaaaaggaccttctttatttaaagagccaccatatttattgagtctcaaacacataagaatattttaccaaatgctcacttcgggacaagcaatgctcagttaacttaaaagcgaggtcttggaaaagggcaagcaatccaggatgtacatggcagggtggcaagaatattgcccccagtaatctaaagcaaattcataggggttcatggaagaaaaaaatttgaagaaagaggcaatggagcaaacaacagaaagagaggtttcccttaatagtcatttgagacagctagtattacagaagttatgaacatgggtatctgggctataaagaaaaggccataatcatcttttcttattgagataagaacacttaatatgaactttaccctgttaacacatttttttttttttttgagacggagtctcgctctgtcactcaggctggagtgcagtggtgcgcgatctcggctcactgcaagctccgtctcccaggttcacgccattctcctgcctcagcctcccgagtagctgggactacaggtgcctgctaccatgcccggctaattttttctttttttgtatttttagtagagatggggtttcaccgtgttagccaggatggtcttgatctccggacctcggttaacacatttttaagtgcacaaatcggtattgttaactataggcacaatgttatgcagcagacctctagaactttttcatcttgcataactgaaactttatatccattgagcaacaactcgcccttacaatgtatggcaaccatttttctactctctgcttctatgagtttgactaaataatcatctaaataagatgacaaaaagctccgccttattttcactccacttctgaataaaagtgaagataagggattgaagtatcagatacatccattcattgtttcagatagtcaacaacatgaacaacaatattaatttataaatgagattgaataaatttgatgtaaaattgaaaagtaaatgaacatatttcaggcctgaaattatgttttttttttaaaaatctaattatagtcaatgaaaaaacatttttgagtgtataaggggaaaatgtgtttaacaaactctgtgttgagatttatttttctggaagtctttgaaaacaaagattgtattctctgagatcaagggcacgggctagaatagtccagcctgcttgcaggtctgtgatactatggaggaatagtttactgcgcacacagcatcttgaacagctgtttgactcttaattctaaggctgggctgcttccaacaatcactggggaagttacttcctactgacaataatgttgttaagttctgagctgaccttgagagatcactggtgaaaactcaatctagttcccgtggccatttagggaattaggtcttaggtcattaagcctaaactttaagatttggaaattacttctgaaatgttagtagaaatgaatggattattagaaaaccctgtgacaaattaatttgtgtatgttctcaagatactgagccaaaatttgagattgtcaagtataagtggtaaataatatctgaatcataccctttgtgtctgtctatcaacataatccaaaaatggaaccctggttcattctaagcacatacactcaaacgtgatcattcccaagtctttctcagatggcaacatcattattttatttgttcaagccattgacctcagaattttccttgactctttgcttcctctcaaactccacattctatctatcttaagttctatcaattctaccctccaaatatatcttcgatcaaataattattcaccatacctatcatttccactctagtccaagtaatcatttccttctgagatgactccaccaccctccttttctgtgtcttcagtttcgctctttttatagtcaattctccatagcagcaagagtcaacttctaaacacataaatcagatcacatcatccctgctgagagccttccagtgatgtttccttacttccagtgatgtctctttactcacagaataaaatccacctccaaactatggcctgcaagaccattcattatctggcctttccctctttctagaacctatcactgtctactgatcttatttcccttgagatacacagctcatcttgctatttctacaacactcaaaacctgttcttaccattgggcttttgaatttggtgcttcttctgcctagaatcctcttcattcaaggtttttgcatggtttactcactcacacaggttttgtttgtttgtttttttgagacagggtctcactctgccacccaggctagagtgcagtggcacaatcttggttcacttcaacctccgcctcccaagttcaagcgattctggtacctcagcctcctgggtagctgggactacaggcacgtgtcaccacgcccagctagtttttggtagaaacgtagtttcactatgttggccaggctggtttcgaactcttgacgtccagggatctgcctgtttcagccacccaaagtgctgggattacaggcatgagccactgcacccggcctcacacaagtctttaccccaaaataacctcctcacataggccagtactcctcaatctttctctattcatgctttgtttattttctcttcatagcacttactacccaacataatttcatatattaatttatgggtttactatgtatttctgtcactaaaatctaaacatccataggggcagagactcattttgttccctaacatatgcttaacatagagtaggctcttcataaaaaaagttcttgaaagaaccaataaattctaggaatctgagttatggtataatttttcctaaaataatgtttttgggggacaaaaggaagagcacagaaaaaaatcaaggggatcatttgtaattaaatgaataatgtgtgtaaaagtgctttgtcaaggcaaaacactatgcagatactgttttaaagagtatttgtcaggacatcaaaatattttgacaaagtgagagagaagactggtagagaagtcagtttgtaaattattcacatctcatcttgttacagtcattaaagcaaagcagcaattcctagatgactcagttcttcagttttgatgataaagctagttttcagaagacttagacttagttttcagaagactcaaatgcctagaaatgcagttctaaaaataatttttaagtcatttctattcagcatccctaaatatgactgcataggatatcaaacttatacaaaaatgatgaagaatagatcaaaaagacgtctatttcctccaacgcggctaaaaagacaccttagagtagatataactaacagtcaagtggtttagaaactctaagaggccaggtcattgaatgttagaatgaatcactctggccgggcgcggtggctcacgcctgtaatcccagcactttgggaggctgaggcgggtggatcacgaggtcaggagatcgagaccatcctggctaacacggtgaaaccccgtctctactaaaaatacaaaacattagccaggtgtggtggtgggtgcctgtagtcccagctgaggcaggagaaggagaatggcgtgaacccaggaggtggagcttgcggtgagccgagatcgcaccgctgcactccagcctgggctgcaggcgagactccatctcaaaaaaaaattaaagaaaaaataaataaaaagaaaagaaaaaagaatgaatcactctatcgcaacttttggttgtttttcagaggtgatagggaacaacgcatttttcttaacacagagctgacttaaatcttaacattcacaaatgacatccaaagatattttctctttctgtaaaaagaaaacacagaaaactcgtcaagctaacatacatactaaaatgtatcccacgtaagcaggccagcactgataacagaatgagcctaaataaatgtataatctacaacatgatttcaggataattttattgaatttctcagcctgtctctcactttgtggtgacttctgaagaaatcgaacatgcataatatatgacctgacaaatgaacaagtaaactactttattcaagccttttcatttgtcaacagcatccaagcaataatggctttctgtccactcttttaataatgtatgtattgattacttccatctaaatcttaaccagaaaatctcgggaagctttgaaggtatccttaatgatctctagggaagggattatagagatttttttaattgaaagatgaaaacctagtgacaaacaatttcattagtaaaaaggcaaacaaaaagtcattacctacactgttgttacaatcaagatctaatctccatttggatttggggtaggaggaagggagttgaataagctgatgttttattgcagttctccttagaaattccccactatgatttgctcctttaaaactctctctaggttaatcacagaagtagacaagtaataaatatcactttagtgactgctcaagtaaaacaaaggaagtcagtttttaaaatatatctggaccagaataacacccactaattgaaaacgagtcagtctagtgaggcaagtaatgaggaactgtaaaagccaggataatgtattcaaaagacataaaaattggtcagtttatatttgctaaggcatatttgagctttaattatttataacacttcaccgcatctggagcattattttattaattagtcttgagagccattcagttgcagttgttatgctgcccagctggtttggggagcacagatctactcccatgggtgtgaaaattgctttgaggagtgagactatggtccccaaatatgtctgtggagtatcttggaattttacctacagaagaaccatatatctctccatgacagcaattgatattgactgtatattttctctacaagaaaagagtacaagatatgtaatattttgctacaaaatattatcactaatctgaaatggtatacaaagaaaaacacaaattacctgttttgtaaacatcctgatttatagaaaatgaaagtgaaaatgaacaacatttgattttagtttcaactattgacattttaatgggatttgtatccccataaaaagcatcagcaaaggatattaataatttagaatagagagtaagcagatgactttttaaaaaagtggcactctaaatacttgcggaataagtttacaattacagtgacccatcttgataccaaggattctatacaaacaacaattaaatcaagaaacccataaagagcaatacaatgtacaattctggaaacatggcaaagtaaaacaaaagtccacaaatataagatctgtcaactattagatcttgatggaattttgtactgattctgttctttttctctttttctaactgagttcaggagatctgatacgcagatccagtttcaaggattttccattgttcttttgcccataggcttcaagagcatcactaactagacagtccatatatgaaagggctaccacatacatgtgacaaaactttgagtcaaacaggctactaaactgttctctcatcagcactcaggagcgatgatgttgtttgaggaaggagagtgttttgtgtcaagaatttttcttaaagataccaagagaagcttgaaaaagcattgcgccaaactacaagtaaaagctgtatgtcgtatgtttattgaagcaccattcacaatagcaaaggcgtggaaccaacccaaatgcccatcaatgatatactggattaagaaaatgtggcacatgtacaccatggaatactgtgaagccataaaaaaggatgagatcatgtcctttgcagggacatggatgaagctggaaaccatcattctcagcaaactaacagaggaaccgaaaaccaaacactgcatggtctcactcataagtgggagataaacaatgaaaacatatggacacagggaggggaacatcacacactggggcctgtcagggggtggggggctaggggagggatagcattaggagaaatacctaatgtagatgacgggttgatgggtgtggcaaaccaccatggcacatgtatacctatgtaacaaacctgcactttctgcacatgtatcccagaatgtaaagtataataataaaaaaaaacctgtgcatcaaagtagctctacacactttacaaaaagatgcttaattagaaataaacagaaaactcctgtaaataagaagggaataccactctattctttctttccctgctcttggtctcaatagccttcctttatctaaccagtgtctactgtatactaggcactttggaatgtgctgagtagaaaaatgacagctttccccctcccaaaaatcttcttgaaggacatggtttagcaagagtagtcgatatttatcaaatagtaacacatgtacgtgatgacaaacaacgctatgttatagaaaagtagacaattttagaagtgtgtaaagaaagatctggtcaaatgtagacaacagggaaaagtttgcacaatgtccgagccaagatgtaaaggattattagatgataaccaggatattatgagtgggtgggtataggtaaaagggtttgagacagaggaccaacatatttaaagccccacataagagggacacgcagaattggaaaaagtaaatggaggcagtatggctggcatccaaacagcaagggaagagcatctaggaaagaggaggctgaggccagacaagccagatagtgccttgtcacccttgttgaggattttggtctttttccaagagcactgagaagactactatagtgttaagataaggactgatataattggatttatgttttttacacagattattctgactgaaatgtagagattgcattgtagggtggcaagagtagatgcagaaaggttaggagaaatggtcttctataattatgatgataacaatagtagacagtcaaaaacaattttgaaggtaaattggccaggtgcggtggctcacgcctgtaatcccagcactttgggaggccaagacaggcagatcacgaggtcaagagatcgagaccatctggccaacacggtgaaaccctgtctctactaaaaatacaaacattaggtgggcatggtggcgcgtgcctgtagtcccagctactcgggaggctgaggcgggagaattgcttgaaccaggaggcggaggttgcagtgagccaagattgtgccattgcaactccagcctggtgacagagcaagacccagtctcaaaaaaaaaaaaaaaaaaaaattgacccagtgatgtcttggtagtggaaggctgaaggctggtcatccggaaaaggtactgtaccagacaactacattgttgtctggtatgagaaaatatttagttagagtctcggaatatttagctagagttttggagttttgtagattgcagcaacaaaaagataaagaagcaaagggtttcagacttttgaaaacaagttattaaaatttagatgattgaatctaagttgtatttggaaggaggtaaatatggaagggcagaggaactaatgtataaaacacagagtaatcaatgggctggaagtcctgtgaaattcacgaaaggttaacaggtagctatctgagcaagcacactaaccaagtggggacggattaacttcattctggtgagtatcactcataactctagcatcaccatctccccaagtcatgttctttgtcatgagattcctgagtaaggactgcgttaagtacagacattttaccactcttaacaagcaaccaaaactaataaccaggaatagtgaagcagtatttataacaaaatactggctggaagaaaccacagcaattatttggaccaatttcctcatattacagttgaagaacaaaatagcaatcagaatccatcttatgaagaaatatgactagaatctcagtctcctgactcctagtgcacatgtccagtgattcattttctttggtttctggaactagcataaaattcatcttttgtagaaattctgtctcatttcactatatcgcataatgcattttttaaaaaaggcccatccttctcaatgagtgcttttctatatgtacaccagagtgttttggctgtttattcaaagtcagaacatttaaaacacatagcaccattacatttcaccctaccacaaaagctaatttaatattcagaaatatatgaaggcaaatggctaaaggagaaactggcagtttccctggcatttttttttttttttgcaaagatccctgggtcttctttcatgttctcttccctttttataatttcctatatcctcttctccagaataatataaacccttgacctttcctcaagatgccacctttggctgtatctccacagagatctttcctttacatgctcaacatacaaaagtggtaccattttatcaagtttttattatttggtagtaatttgtttggtttgctattcatttctgttcttgtatcttttattctcatttccaaaacacttatcagtatccactctacaccagacactttactagactctagggtcttggaggtgaacaagacaaaatctctgcctttttcactcagagcttagtagagaagatagaaatgtaaataaaaataaaacaaacaaacaaagaaataattggtcatcgttggaggatgctagtgaacaagttgttattataaaaattggtaaaattgaaacgtattttgcttgttcggtatgaaaggtatactgagtaccaaaataggagacaagtgcaaaacatttttttcatagacctaccccagtgaataaatgaagaaggaatggtagagataggcaattatcacactgcaacccctagccactgatcgtgaacagctattaaacatcacacaaaaagagaaaacaaggcattatataccacctcctgatgatggaagaatacacgaacacctgtgaagcagtcttgccaaaaaaagccaaacccaaatacaatcaaactatagaactgcactgttcaatcggtagctactggcaacatctggctactgagtacttggaatgtaatgagcctgaattgagatgtgctgtaaatgtacattttttctattgattgcatgttgaaatgacaataagaattgtactacagttgcatgacatataatgatgaaaagaaacagggtgaaagatacagggaaactattctattttagaaacttactgtgaatctgtaattacttccaaacaaaaagtaataaaaagaccaactaaccaaagtaaggtgtgggtctgatttcaatttttatttaaaccaaaaccagaaaaagtttaaaaaatgcataatatgtatgagaaaaatggaaatttgaatatggactggatatttgatatgatgaaattattgatatttcaaaagcattatagtagcaaggtgattaccttaaaagagtgaatcctatcttttaaccttttgaaatattaacaataaaataacacacgcctgatatttgttttaaaacaatctgggaagagctatagaataaataagatctgacgtgatttgataattgttgatgtcttgatgagtacgagttttattatagcattctgtctacttttgtatatgttcaatatttttcatcatgaaaagcttttttttatatagccaaaagagatggacgatttcttaaagggtattattaacacaaatgtgtttgacatttacagtgtaatggcttagattatttataattgacccttgggtgagaagagtaaaaaagatttctattcaacttaatttcaaacaaaattaattttaaaatagtcactggattactatgtgcttaacatgtgcaaggcacgaggcttaaaaatgtcctaccctatgtacatcgttctgcttctgaactgctggaaagtcgcctccaataggtgcctgccggcttaattcatcatctttcagctgtagccacaccagaagttcctgcagagaaaggtgcagacgcttccactggtcagaactggcttccaaatgggacctgaaaaagaacagcagcgtaccatgtcagaatatctagaagtgtaattgatgattctaacaattccattgaaaaagtacaataaacctattgtgaactacaaagcagtcttgaataaaaatctggctacttacttttgagagccacaaaacagaggatagtttgatggcaattttgagaaaaggcagtgtttagccatatgtttatttccacatgcagaatgctgagacttttggcatgaaatacacactggaatctattgcttttccatactgttgtagtcaacaattcttaatatttctggtagaaaaaattggatgcagtgactaatgaaaaacacttcgttttcatgtgactcatgctagtactggaattctttttgccttgagaaatggaaaggtctctccccacattttgacttttccatttctacaccctaggcagccttttccattgagttcttccatctggcgtctgttcctttctgctcctcttcccaaatgcgtctcctttccccctacccttctttatttgtgtgcacctgggatttgtcttcaccaagtttcaacattttctgctttgtttcctttgtgtaaaaagtactaagacaacaactcacatggaagagtaaaatcagacatttatctgaaagcttcccccgaacatgaataatttaggcaggagactgagtgctttaccgtcaactgtatttagaacacgttaatccttagaagccatttaagaatacacaaatgaatgatctgtgctataaaatccacatttcacttgaagatgagaagctaaattaataaaataaatcatcatccagaaaacaaagaggaaacgcagtgttagcaaagctttatcttcaggtaaattagaaattatgctcaatcactcagctattatcagcaattactaattaattcataataacgctacctataacataaatataataaagactttaacgctgcaaagattgaaatgtaaagcaaagcaaccaggtggagcaacatttcccttagccatttggtaacttagcttgacattacaaatacaattctccttttggccttagtcaaacagaatcaccaaagaatacttatctactgaaattaaattgttccaaactttctgaaggataatttgacaatacataaaagtctttaaaatgtgcaaagacaatgacccacaggcttaaattcaaggaaattatactaacaaagaaattggaaaaagatacaaagatataggtggaaaaatgttatatatagcatcatttatgattgataaaacaaaacagaaacaacttaaatattcaatatgagggaattgcttgagaaatgcaaaaccccaacctactgattgttttcaaatgtaatgaaacttgtatatgctttaaatttagaaattaatgaaatttatatatgaatttaattaaatagctcttaatttaaaagggaattattacatatataatggtgcattcatacagtaaaatcctttgcaaggttcaatatgatgacatagccaaatatttatggatatggaaaaggtcatcatcccagttactaaatgagaaaacaggttacaaaacaaatacattttttgaatttttctaaaacatttgtgtatgtgtatgtatttgtatgcacatgcttgactaggaaaaaattttgtaatgacaaccaggttatccctcagaggtagatttacaggtgatttatttcttaatctttctacttttccaaattgtcaagattttctttctataattgcagtataaacaatatgtccaggaaaaatgaaggcatttccatcaaataagataaattaaattgttccagactctaagggtattatttcccaagaactgaatcgtgaaataccataaatgtcatgaattgaatataatagtgcatgcagattgcatacaattagaggtcagttcttttatgtttctgtaccatcctttcagttaccacttttccatgataagcctaagcgacaattccccatgcaagattttagctgtttaatagcatgtaatgtgtaatggttaaacgaattccttggggtgtctggaattcacagcttggtccctttgagagtgaaaagaggctgtcaagcaggacatattgaaaagtaggtggagagaggtagggctcagacatggaaaagcagcaaatggtagaaaagacactgattaaataaatatttattgactgcccctaagtctctaggatacattggggagtagggagagaggaagggaagagagaatataacgatgactaatgtttggcctctgtctgcctggtagaggaaacaaaatatccttgtggcagagaggtctagaggaggatatagtgaagggcaggctgcctatgttaagacctcaagctgcggctttgtttatgtaaggaagtgctaaaattccagttctaggttaaatggtgctgactcattattagtgggtcaatgaacccctttaggtcccctaagagagagcaaaataactgagacctagggaattcagttcttttttttttttttttttggtgagacagagtcttgatctatcacccaggctggagtgcaatggcacgatcttggctcactgcacctccacctcccgggttcaagcaattctcctgcatcagcctcccaagtggctgggattacaggcgcccaccaccacacccagctaatttttggtatttttagtagagatggggtttcgccatgctggccaggctggtcttgaactcttgacctcaggtgatccacctgcctcagcctcccaaagtgttgggagtagaggcgtaagctaccacacccagccgggaattcagttctaaaggatctaagagaaacttaatagcatgaaatagggaagttgttagaagccagggacagaggacagtcaagagagctaatacagcagcagaagacggacctggaacctcaaaagacgaaaagctctcacatatctgggtaaggggacttcctttaatttttttctaagctgtggagttagataaaatttcagaatgtttgatcatcctaactacatatcaaattgcttcatttttttcctctcctaaagctcaagagtgaaaggaaaaatgtgataggaggacaaaaactgaagcgaaaaacttacaaaggacagagaacactgagtaagaactgaagaggtgaaaggcagccagagaatgaattaaaacagcatatacaaatgtattcaacctaaagctctgggtctcaaactatagtgtgtataagaaacatttgagtagcttgtttaaaattgagattgctaggtgccacctccagactttctataattctatcaacaatctctgctttcaacaagaaccttcacaattccacaggtaagctccagaaccattctttgataaagcatttattaaagcatttctgatatgccccaaacattacttcttggtctccacagggcaaaggtggcatttgtcagtgacttgattttgaagatctaaatgtaaggaacattgtgagctcaaaacattttctttgaccatgttaagcccgtgaaatgttttcaagtcacatttctaatacatttatcggaagcagttgccctatttttattttcatgagtgtatataccagatattttgaaatgattaacctatgtttgcatgtggaatatctcctcctgaaaatgtttctttgtatttgtaatgacttttttttctggttatatcatacataggctgttggggttggaaggaacctgagagattatagttcaaccttcttgttttgcatatgtagaaatcaagattgcaaaggtataaaacagctgctgaaaaacataacttgagctgtcctatttagatatgggaaatagaaattacaaacctttgttagatgagaaaatccttaaaccttagtggttttaaccaaatgtttttgatctctgaacaaaaaggcttgttgctgttaaattaaattaaattgggcctaaagctgactctgtacatagcaaactgcaacccagcttggcatgtaagcaatatgcaacttaagagtacattcttgtaacaaatagctgagcctcagccaatcccagcagtcaagtttcagctaatcacaggctgtaaactgatcagctcatgtccatataaggcaaatgcctatttacactatgcccaagtaaggcaaattctaagctgtaaccagtcaagctgtttctgtatgtcacttcctttttctatctataaatactgcctgcccaccttgctgggtggagctttctgaacttctaattctgagtactgtctgattcatgaattgttttttgctcaaataaactctgcaaaacggaatttgtctaaagtttgtcttttaacattgctaattgtcaaatatattctgcttactcctacccactcaacggaaaataaaagaggtggttcaaaggggcatgcttagcttctatctatgtctattaatctttattagtgaagacaagagcttaggggttactaccgtttaacaaggcaagtgctaatctctaaaaagctgataatttccacaatttgtaaggtttaggtaaaacgcagagcctttagatgtgctggagtatattgcttggtctttaaggaactcctcagtgtcaggacactaagaattataggggctgataaagtgattgttatttctctagacacagatatttcaactgtgatttggttaatgcctagtttgaaatccttaataaaactttactctgaaaggcatgcattcttaaagtgaaatgtgttatattgaattcatttttcactttgacttcctttataaaactaatgatatatccctataaatctttagtaccctcatgtaataaaatagcacttaaacatgcagaaagaaaagggaggaatgcagaaataataaagaaccacaatactgccataaaaacagacacaaagacccatggaaaagactagagaacccaaaaacgaatccacacacctacagttaactcatttttgacaaaggtgccaagaacatacagtggggaaaagacagtctcttcaacaaatggtgcggaaaaactggatatccatatgcagaatgaatctagacccctatctctcaccatatacaaaaatcaaatcaaagtagattaaagacttaaatgtaagacctcaaaccatgaaactactacaagagaacactgagaaaaatctccagggtgtcatcaacagatgaataatttgaatttgtacttcagaaacaaaaaaaattaaagaaccacagaattaaaatgggagctatctctttaaatagagagaatcccaaagagaagtcaacattttttttttctagacaggtcttgaactccaacatccaaacataattaacattctaaaagagagagaaagaaggtcagagatattcaatgtccaagttgcagttttctctcaaaggtagaccccacctctttttgcccttcttttgttctccattatacaaagacactaactattctaacctctaatagcaagcactccccaatagatttatggcttctacagactatataatgtcagtgtccttgcctcttaatgttcacaattgtataaatgtgaacattttatataacatttacaaatttttctgccaaatataaaaatctcacataatgtaaattctgctgaaattatgttgataacatattatgtgattttcatagttaatagtatatacaatgatctggaaaaataatctagtagtagactaaattgaaatcttcatatatatttcttatgtaaaacaattgacttgaccacttctcaagttattaatattctaaaattaaaaatgcaaggattgtggatatggaattttagaatgaaaaacactttctttgactaattaccatcttaatattggataacgtcatcagtaactgtgtgtgtatgcatgtgtgtgtacatttaagtaaataattttctctttttctcccacttaaagcagttaatgttttcgttttgtttgatggaacttaaattatcactgactacttacttttcttccttatacctcttggccaacatgtgatgtaataatgcatgtggaatgatagcatatacttttcttgaattaaattatgagataggattatacaatttcaattaaatttcttttctctcaaagacatcttaattactttatataatgccttttaaatcaatcagttctattttaattaagaaaaccaaggtagaaaaattaaacaattttccaggttcataaagtgtgattgcagaactaaaagaataaaattgtacgattgcaagagaactggaagagactgtccatatttctggtcaaactcttcatttcagtgaaggagaaaattgaagtctgaagcagttaagtgacttgatcaagattatatgctaagacagttagtgacagaatagaacagaagggaaactgggttgcccagctgctggcccatgtctttctactctaccatactcacatatttcgagtttgaaatttttgtattcatataagttagctggaggcagtaagcatagccctataaagcaactcttgaacacttgaagaaacatgttatcaagtgtaaattagaatagtattgggaagacctagtgaggaaacagccagaaaagaaaagatttgttatggaatatgaatcaaaatttggagaataagaggaaagagaatgttgcaagtgtgagaaccagcaagggtacatactcatatgggagagtgaggaaattgttggagagtaggaatggggttagaaaatagaatttattgattctcttggctcagagaatctatgttggggagtaacagaatgatgcttggtgagaaaggaactggaggcagaaaaagaaaagagaagggaaggagttagcaaggacttattaggcacagttggcagagagagaaggttctactagattctaatgattaaatataacttcattagagcagtgattttttttggtatgttttattcatggttgcatcctccgtgcccagaagagtgcctagtacatagtaggcattcattaaatatttgttgaatgaacaaataaatgaatgagggagatatggagacctacaagattgaagctttgaacaaaagagtaatatgatataaacagcgtccaaggtagagtattcttgcaaatgtatcaatatggcataacatgatgacttaaataagaatcttaatcacaggaagagaaaagatgtatggcagaagaaaaataaatggaaggaaaacgatacaatatggacttgtatttggaagcacaaggatatctcttatgagccaatggaatacaaagggaaacttcgaaatcatttggatttaaattcaattttgtttctttaaaaatggacacattaatggttttatttttttgaaatataagagcagtttcagaatcgctcaccaaacaatgggccaactgtaattttttataatatgttataacttgggcaaacacaggcctatttttccagtatatcattgaaactattttttaattgtggcaacttttcattttaaaataacccccatggaagaagtgacaagattcataatgcaggtttatcagtgccactaatggttctatatctaactcttccagtgttattctattctatttcataatcatccctaattactgcctatactgtacttctctcaattgaaccctgccatttgctgtagattgatcaataccctaatttcaatcaagtgtcaggaaataagctaaattgctttgatgtggagaattacttctttgctttttatgagtgcttataacatatcctgtattattacataggcctatataaaagccaaaaccattgatctgaatatttaaattctagaattggcagcaccttagataagctaactgttttctacctgattaatgacagcaagaatcaaactgcggtagctgacatgggaaactgctgagaatgaagagtccatattttggctgacatgctatttgccactttcaattctccttttattttatcaagttcacatgaggcagagaaaaggcactaagtgatactcggaacaattatagcatctttctttttcttttgtgcagaaaagaataacttaacttgacctgccaatattttttccatctcacattttcattcttttttaatgacgaaggttatcaaagtggcctacgtcatcacacatactgacctctcttaagagtttaagctgtagaaagctaatagagcctccctatctttgaaaatgctattgccattgttgctcccagtgtaccaccaccaagttgacacaaaattcatatacaaaatagggagataaggaacaatgtctgggaagccagggtgcaaacttgtgaaaaacaaaacaaaacaaaaccttatacataaaaataaacctgttctactcctagcaatctacttctcataaaaacaaatccttttctactcctagaaaaaatctactctctatttcatcctttcaattagtatgcatttctttgtagaagtttccttctttctttatatgctacggtatcatatggtggttaaaagttcagactctgaagtcagactccctgatttctttttcttttacttttttcttttttcttttgagacagagtctcactctgtcccctaggctggagtgaagtggtgcgatctcggctcactgcaacctccacctcccgggttcaagcgattctcctgcctcagcctcctgagtagctgggactacaggcgcgtgccaccatgcccagctaatttttgtatttttggtagagacgggatttcaccatgttggccaggatggtctcgatctcttgacctcgtgatccacctgcctcggcctcccaaagtgctgggattacaggcgtgagccactacgcctggcccacccagactccctgttttcatcttgtatcttccacttgctaagtgaccctaaggaaattatttagcctctctgtgcctcactttcttcaaatgtaaaaagaattcaataataaaatctacctcttagggttgctgagagcattaaaccggtcaatgaatggaaagtgcttatggcattgcgtggtatgtaggtacatcatgtaaatattagttgctatcattatttcatacttgatgcagacatttacaatagtgcttctgaattactaaaaatgcagattttcctccttatagaagtatatatgttaaaattttggacaagttagaagaactataaagaagaaaaaaaatctcccttctgtaatctttctacctagaggtagtaactactcccgtcatttagtgtatactcccataactattattaagtccatttggtcatcttctacctcccttcattatcactttttctctagacacagaagaaagcacaaaatatttttaataaagagaaatgaattaagaaaggcaactgcttagaaagcaggaagcctggctttcattccccgcccttgctagatcatttaagttacaatgggcgttttacttactatctctatccttttgttcctccacggaactattgcaaaactggtataacaagaacttccctctgccctttttacaaagatgctatgatgcatccattaactaacttctccaaagaaagctggcacatagaagggggcaaaatataaagtatgtgagtatactacaactaaaagcttagtttacagaggatgtgttttaacaaaatctgagaggaagcaaaagacaggaagttgctatagtctctctttaactgtaggagctatctcctctaaactgttaattataatgtgttacaggttttatattatataattgtaatgtgttataaagggttttaaagactgtcctctggtatgcatttagactaatgccaaaaataattccataatacatatccgttaattttttatcactttttgtataaccctgtgatatgccaagagagaaatttatgaaactagaatagctgcactcctcatttaaattcactctgatgtcttaatatgcatgtctcctatgtttataaaacattaccactttaatctaatctgaatcctcaagtatcatctccataccaagcaaataaatgattcatttattcaaaatacagtgaatcattctgaaattggatgatttacgtagacatgtgagataccagttacttgtgctaagacaatgaggaaaatttggccattttaattcatttgtggcctttttgctccacatcttttcctacctaatgttgagagactttttccgaagttcactccacttgaagttcatgttatccaaacgtctttgtaacaggactgcatcatcggaaccttccagggatctcaggattttttggctgttttcatccaggttgtgataaacatctgtgtgagcttcaatttcaccttggaggtcctacaggacagcaggaagaagaatatgtgcagaattaccaaacaaaagaaacaagcgatgaatgtgaatttggagaattgcaaaatataaataattattagttcaaaagacatttcaatcaggctaaactaacaagaagatacatctcaaatcccttttcttggcgtattgccttctcctgttattatgtagatttaaaatgggcatcttattagttgtaatagatttattccttgccattatgagttggaaagtaatgtatttataactttataaagttcacaagttatatcttctagtctatggacaaaatgtattattttatggaagtgataggcaataaaattctatgataaagtgtaccccagtgccaataatttcattactatatggatcaagtcatattttctatttacgtagtaatctgtagagttaactctgaccataaaagcgtggagagactaataaacaagattgcacttggcccacagcaccagcacattcctgggagtctgtcatgggagagaaaatcttcttgacaacacaaattaagttcaccttggtattatagcatcatacatatagtacagcatcatacatttattagttttgatttcccatttaatacacatttttaggcttgacaggtggaaagtacataggaccttggtaagagttatgataagaggttatgcattcaacttcacttgtatacacacagatcaagaaaattattatagtagaagaatctgacctttacatggtatgtcttcctgtgtaacattttcagcttgaaccgggcactacagcactgatcctgttgcatagcaatcctgagaaaacccagaaactgaaagagccctgctttaaaatgccaactttgcttacattctgttgacagaatgaattttggagcacaggcctcaccagtcaataataataaacggccactttgtactccgcactaaacagtagccaggcgtgtggatgtgggaggaacctcaaagagaggaggcctggaatatgcaactgacagtttatattaaacagccaacttttcttatcattctgccattacaagccagagacattataaattcattttatatatgtgtttccttccttgttcccagcagaatagtcaaagccaagggaacattcctcagagagctgccgggtaccagcattcctttctgcctacacaatgaatggaggctttgtatattatctgacttgctcttagagatttgtatgcttctgttcaacaagtttaaaaattcattctgaagctccaaacaattggattgatctgtgtaactagaaaagttttttttttctctctctctctcaaattgaattaaattactctgctaaagtaagggagaaaaagtggcagaaataacatgttagaaattctgaagaactggctcaagttttcagccacagcctcttaagatgcagaattctgaatgttgaacaagtaaggtagacagacaatgaatgtctattgtcactatttttggcagctaaagcatcactgatggactctaaagagagttgtgtcccattctctttgactgggagacaggcaggggaatatggatagaatcacatcagaagttgaaagaagggaaatactgaaagtatttctgagtagtatctctgagtagtacaaaccaggtttgtactggaaggatatagcctgattttgaaagtagtttatatggtagaaggttagtattgggattcttgcagaacgaagtttggtcaaatatatagccattttatgtttttctttcttttttccttttgcctacgtggaataacatgcctgcctaatttgcacttcttcagcaaaagagaaaagtgagttaatttatctaagtacttcaggagaaaaagccaaccagatctaagttccagataattccttcacttgtcttttactttacttcttctgttgtacttgatttgtacagtactttccttttgtgtatgcacttaggggattaaagacaaacttttagttgttcaagtaaaagtattctcactagtagcatcagttttctatgtttactacattaacatacatataaaggatagtacatttgaaatttatatcctacattgatagcagagacccaggctcaatcacgagctccttaaggttatgtataccatgaagtcaccaacactttctttgtcttctcaagcataaataggatgttgattcatgaatttgctacttttcatctttgccatatatattatactgcatataaacatctttgttgtattatcaacaaataaatgaatataaaattgataaacaagcatttattgaggactgatttattgtctagttttagcactttgggaaatgtaagaggagtacaaatgatagttctgtctttaattttcctaaaacctagtgtgcatttttgtttaattcgtttatattaccaactaaatattgacggcaattcctgccaagtcttcatagatactgggataaagactccttcctttagaaatgcagaaatggctaaagttatcttagcattggcaagaagataagtcttctgtcagtactgcttttctaggtcatgatggtgatacagagctgtaaatgacacgtgtacagtaaagggctttacaggttacaaagcacgtacaaatgtaccaccttagttattcctccccctggctctgtgaagtacatcacattttctgttttgcagatgagagcactgagactcggatgtttaactgacttgcctaaaagccatatagctgataagtgttagaactgggaaatggatccaattctcttgattctagaagatcttgggctgcctccaccaacccacttgccagaagcattggatataatacacagtagtcactgaacctgaacgaagatactacttgcaagaggaaataagtgactgttgagggaaaagcaccctgaaagacagcattcttgagtttgataaaatgtttacccacgtggattgatttgttctgaatgaaaaattgaattctgactgctctttttttttttttttttttgagacagagtctcgctctgtcacccaggctggagcacagtggcgcgatcttggctcactgcaagctccgcctcccaggttcacgccattctcctgcctcagcctcccaagtagctgggactataggcgcccgccaccacgcctggctaattttttttgtatttttagtagaaacagggtttcaccatgttagccaggatggtctcgatctcctgacctcgtgatccgcccaccttggcctcccaaagtgcttggattacaggcgtgagccaccacacctggccctgattgctcttttcacttctcatttagcattgggcatcctggaccacctgtgagcaaaaaatgttcacactgaaaaggtctcctttctgcaaatttccctgttgccagaacagaaattctgccatcagtaattcatctctttgtctacaagagccatgtggactactatgaaccataccaagaaatgacttgacacatcagcataaacatagttcatccatgttcctttgggatggcaggctggtaggaaatctttcaagctacaggactcagataggttgccctaaaaggaaggtaagtattgggaaagaacccaaggctctctttcaaaagctggcatgctgtagtggagatttttcagtatcaataaggcagcatgagtcatagattgggaatgcagggcaggctgcaaggaatatacattatacataatataatataatataatataacataacataatataatactaccataatgatatttgtctaaactcatcattttttatttatttatttatttatttattattattattatactttaaattttagggtacatgtgcacaacgtgcaggttagttacatatgtatacatgtgccatgctggtgcgctgcacccactaactcatcatctagcattaggtatatctcccaatgctatccctcccccctccccccaccccacaacagtccccagagtgtgatgttccccttcctgtgtccatgtgttctcattgttcaattcccacctatgagtgagaatatgcggtgtttggtgttctgttcttgtgatagtttactgagaataatgatttccaatttcatccatgtccctacaaaggatgtgaactcatcctttttttatggctgcatagtattccatggtgtatatgtgccacattttcttaatccagtctatcactgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtagaagtgttcctatttctccacatcctctccagcacctgttgtttcctgacttttaaatgattgccattctaactggtgtgagatggtatctcattgtggttttgatttgcatttctctgatggccagtgatggtgagcattttttcatgtgtcttttggctgcataaatgtcttcttttgagaagtgtctgttcatgtccttcacccactttttgatggggttgtttgtttttttcttgtacatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattctggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgttaaagatcagatagttgtagatatgcggcattatttctgagggctctgttctgttccactgatctatatctctgttttggtaccagtaccatgttgttttggttactgtagccttgtagtatagtttgaagtcagctagtgtgatgcctccagctttgttcttttggctcaggattgacttggcgatgtgggctcttttttggttccatatgaactttaaagtagttttttccaattctgtgaagaaaggcattggtagcttgatggggatggcattgaatctgtaaatcaccttgggcagtatggccattttcacaatattgattcttcctacccatgagcatggaatgttcttccatttgtttgtgtcctcttttatttccttgagcagtggtttgtagttctccttgaagaggtccttcacatcccttgtaagttgcattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccaataaactcatcatttaaagactacacctcagactcaggtagcacaaaagagcaaaagattgatatggagaatcaagtggagttctcagtgggtagccaatctggacaaaggataattttcatagaaatttttggatagttttatttcacttctgacttaactagaaaagatcattcaagccttcattactgcattcactgtatgctctctaatttttttcttcttttttgtgattgtagtctttaggaaaagcaataacgaatgaacaaaggggaaaaggtagttgttacataacaaaaaccatagcagcagcagcagcagcaagaacaacaacatacatgaaccttactgtacatcaggtgctgtccaaagcactgtatatacatgagctcattttctcctctcaacaaccctctagggtaggggctactattatcttcattttccatataagataatgaaactactgtaaggttaactaaaaatgcccaggttcacacagctaataaatgcagcaagatttagaacctcgtcagtcagacttcagggattgtgctcttagccactaggctatattacctttcaagtttagttgttggtggtagtttttcctattaataatgctactacctaaattttagcaaatctagcactgccattagaaaataaaggataactatgtcagcacacaaagagcaatttcatggtcttattaatataaagactattaaacagatttgtagcagtggatagagatgcatccaatacaacaagagaaaacacaaagtaattgagaaaatgggtgcaaacgaaacaaataatgtgtgtccccataaaagaaacatttggcctaaagttctgtacaattatagagcaaatttcagctgagagtaccaaaaaagttcagttatgagacaagcaatatgttcacagtatagcagttttaggagtaggggagatcctgttttctgaagggctttttcaaattccacacttccttcttatctgagtctcatctactcttgttgtgaatctcctttctcagcttccagagaaaactcatggcaaagtgcagttaaatagacataggtttgacccttctcttctctttcccttattagccacataatgatgaaaactctttcattactttggtttcactaaacatgaaataataatacatacctgctgaattttttgaatattacatggaatttttgtaaaatactttgaatagcgtctagaacacaagagatctttaataaataatagcaaatgcagggcttactattacaagataatccatgtggaaatcagatgttagaaatagatttcatgaagttacaggacttggcttgagccttgagggatgtatacgattgggaaattggaacaaaagaaaatattccaggtaaaaagaatagcatgggaatggagtaaaggtgaaatgaatttggtttatgagcagggacaatgaattgcacaacctgattggaatggacaatgagagttgagagaaataggtagaatgcagaccaactgcttaaaccaagtagaataaagtcttcctttaggaagccaccgagaataaaagtttagaaagaaaagtacaaagacaagattatcgaatattaaatttgtactatttcattcaaaaagtagaatgatccatggtgttcataagtaataatacaactggggaagaataggaaaagttatggatgttttactagaagaaaaataaagaagggagatgtcaagaattagtgctgtacccttctttttattattaaccattttattaaccattaagcagatggttgtgatactattctagaacatcatgaataatcgtatccacatatttcctttcctatgtaaatggaattattggtctctaaaataggactcagcaaatgaaaacttccccattttaatatagctgagaagtaaggaaacaaacacaatggtgtagaaagaataacaataagtgaccaaatctccttaagaattttattatagacagattatctctaagcttttctgaaagcagttagtatatgaataattataaggccattagttcctccttactgataatttttatctaatttaaattagcttgatgggaaaaaaagtggtctgatttctaagaacttagaaggtcaggaacatacaattcaaaatagtaaagaaattatcctaagtggctaaattgagagtaggaagaagtgacaccttacagagaatcagaaaggtgtaaaaggagccatgggcatgcataattgaccagggtcacacagtgtggaaactaacagctctccatgcatcagtagcccttgaaggcatcacctcgttttatagcgaagcaaaatagttaatgctcaggatgatgatgctgaattagccagggaaagcagatttacattcagtaaaatctgtttaagaagaaagcagtgtatgtaaatgcttcaaatgaccaaatgactgttatttgatacagttgttttgaaaaggtgttaatgatttaaataaaaataaaacaaaaacaattatatgaaagtagaactcccttagactggttatccaacatgactcattaaacatgagctctaaatagtagagcttttggagcacacttgcatacactcatacgtatacacacacagaaacagatattctattatgaagacataagaacagaaattgaaagcaaatctttagaaacgtgtacagcaatctaaaaataaaaagcatcggcttaaattttgtatgtctggtatttgtaatttttaaaataattcatttttattgcatgttacaaaagtatcagtctattatggattgggaattaaaacaagcgcaaaaaaaaaaaaaaaaaaacccgaagtggatctttcctaacaagtttttcgagaagaatccataggaagaaattggacccacagtcttggccttatcaggattctaatctaaccaccggaggttcctaaccagatcagaaaatgcagttggatacagactcacaagagggtgtgactgttttttcccttcttattctatatgtggccacgcaacacctttaaaagcagcagagttgtcgtcccaagagaaacaagagttaatttgaggactgctgtttggcttggagcctggttgctctaggtagataaggagtatgttttcaggtccactgcattgcgttgcatcttaaacgagcagctatggatttaggagtccacaggctttgctttaaaaacggctgttattaaagtcctcagagactattatcctgcagggtttgttgtctttgctttcatatctcattcgaaaattctcacacttaagcactgcaacagcagagagaagggatatgctctctcagcagggagaagggatatgctttcttgcctcagtatattcccaagtgcaaagcttcatttcaaaatctaatctttaaaaatgcctggcctagggtggattacccccggaggaaactgtcaaaccgccttaagcaatcccgaactctggtaatacgtgatgctttctctccttgtgtgaccctctgactccattcttaagattaccttttaaaactgatgagttcatttaagatctcctaggttggaagtaagatgagaggtatctttctcatctacgtcttgtttttcctagtttcttctcatccagtcacaatgcaaaaattcccgaatatttattcatcacaaaaatgtgcattaagtacctattgtatgtctataagtagggccgataatacctaccttttaaggttttggcaaagattagatgagatgatgtgagtagatcaaccaagtacctaacccaatgcctaacctattgtgaggtttcattaatgttgcatccttctagtccccctctcactttctgccatgactccaatcctgctagcagagaagatatgaggccgttcaaaagaaaacgaatacctactgcatgaagatgggagccagagctacaggcaggagctaagaggtagttctcaggaagttcaggttcaaagggtacagtgtagccaatgagagcttagaatgccgcctggagatttttatctgattctgtaaggataatattccactgtagcttcttgtgtaaaggtgtaacattgtgaaaatagcatctggtaatgattattgggaggatggtgttcagggtaaatgtagcagggtcagagtgaaggcaggaagtctagtggacaggcagtcccagccatacaggaaccaaaacagcagtggcttcagaatcagagagaaggtaaagaagagggatgctaccatcattgagtgctcataagttataaaaatagctgcatgtgtgatttaattccatccttctcttgtcctacctttggaaggtagaattcaggaaagtgataactattcacaagtacattttaaagatagaaatgttatttaaagttctatttctcaaggagtaagaaaaaaatacatatgctgtgtttcaaacacacacacacacacacacacacacacacacacacacacacacaccttggggccaaataaattagaatgacaaaaccattgacaccaaatgacaagggcattgacatcaaagctccatataggcacaggtgactcccacctaaaatataccctatcaagcattcctaaactatatgggtgccagttctaaaggacacaatttcctgagaaaaagtgggtagagtaacactgcttcagatatttttaaaaagaagccgtggacccagtggagaactaatgttgatattcatttggctctgcacataaactttaaaaaagaatggcatgccttttaattctggtgttgaaagagaaaacgagtcttaaagacaggctgagttttctttttttaatactgcatctaaaatccatagaaaatactgtgctgcaatattatttctgatattgctatacagcctcagtgctcataattgggtgagcatttcctgcatgagacatctttcagatcagtgccaacagtaatcttgaaagaccttaacatgcaaaccctagattgtacatttaagtcacagagacaaccacatatgaaaagtctacaatgttgaaggtacttttggttttttatattatattttatgtgcaggaatcagtctgtttgaagaaaactacccttatctgagaaagaccagatgggtctttccaactctgagacatatttgtttttgcagagccatgatgaggggtgggggtagggtagggggatgaaacagggcaggaactaatacttacagcccttataaatcctttacaccaactctatgaaataggccttctttatcccctatcgaggaaaccacgagtttgagaggtaaagtaacttatacaaatcatagagttgttgttatgtggcagaagcagggttagagcatagatcttcctgaaactaggttatttttattctcttccctccaagctccagtgtcttccccatccattaaatacaaagcaagtgacttctgacttgggctacatgtatcacagcaacataattataataactcattaaggcatctgtgagatatttagtttcagagcactgataggaatggtcaacaactgaataattttccaattaggtattgcttttaaaaatttatccttagtcaactcagaactaatatcattgatgtttctgaatggttctaaatgaacacaatacactcctattcttcaaataggtaactctcttcccatggaccaatacatatttggttatattaatctgtgcaatttgtctatattacatagagagttaaaagctcgaaaagctcttatttctggaatctctttgtcactaagctattttttgtcctccagagaatcactgtggttcaaggttgtatattagaaaaaagcaattagttgatgtcaagtctcatcttttcccaataacacatatctaagaagaaagcaagaacatatggcaaagtgccataattatttttgatcatacactagaaatcacaacagccatgtaggtaattccctctggcttgttttaattattagggttgtaaatgcaaacaacaacttcattctatcccccactttaccccctaaaaacctcaaaatactcccacgcaaccacaaaacaaccctacactgatgtaattgtttacaataggttaatgataggaaaatctaagacatttctatttttttcattttaaatagcaggacaatttccaaaataatcacagacactcatcagacacaactgtattcatttgtgggtactctttagcccacagcatagagatattaaccttaaaactatttctaggtattcataagttttgaatgttaaagaaggttctagtaccatgatgtaaactaaagtcctgctgatataattggatctgattctctggtgatcttcagtgagttaatttctgtctactaccaagtagagcaaattctttcttctggagagtgtgacttttgtgtgtgtgcctagatagttctttcatcctattttgcttttcttctcttatacaatagggtgaacagtgatggggagaaaacaaagttactcttttgttaatgtatgaggaaaaggaggaagacaggggatatgcatgtggacactgatgtaaaggtaggtaatatttggcatatttgccgggaaaaaaatgtcataaaggaaaagtaggcaaaatgctaaggtacatttcctcattcttagaacccattcatgagctttccattgtgatatggtttggctttgtgtcctcacccaaatctcatctagaactgtaatccgggggaacctggtgggaggtgattggatcatgggggtggcttcccccatgctgttttcccatgtgatagtgagtgagttctcatgagatttgatggttttataaggggctcttcccattcactctttctctctctctcctgctgccttgtgaaggtgcttccttcccctttgctttccaccatgattataagtttcctgaggcctccccagccacacagaactgtgagtcaactaaacctctttttctttaaataaattaccccagtctcagggaagttctttatagcagtgtgaaacgaactaatatacatcgtgtatctattaattcttcccaaagcattcagttcagttcagaagatgctagagacccttagaccatctcactgaagcaggtccagggtattttttgtgtccttgtgccatgatgcaatgttcttttcttcttctttttttttgagacggagtcttgctctgttgcccaggctggagtgcagtggcgcgatctcggctcactgcaagctccacctcccgggttcacgccattctcctgcctcagcctcccaagtagctgggactacaggcgcccgccaccacgcccggctaattttttgtattttaagtagatacggggtgtcaccatgttagccaggatggtctcgatctcctgacctcgtgatctgcccacctcagcctcccaaagtgctgggattacaggcgttgagccaccgcgcccggccgcaatgctcttttcaactgagaacaagtacatttggaaaatcatccccaaaagagcaaggtttgggaaggcttaggcctttccatgcccatatgacatgttatataagtcttatgaagaactagaacagataagaggatgactttacagattattttacaagaatttttacatgagaatgacttttttttttttttgagacagagttttgctcttgtcgcccaggctggagtgcaatggtgtgatctcggctcactgcaacctctgtccccctcctgggttcaagcgattctcctgcctcagcctcctgagtagctgggattacaggcacctgccaccatgcccggccagtttttttatttttagtagagacagggtttcaccatgttggccaggctggtgtcgaactcctaaccttatgtgacccacctgcctcagcttcccaaagtgctgggattataggcgtgagccactgcacctggactacattttaataacgattaaagaacagtggaaatctgcttcataacaccctgagtaagaaatgagaaattgtagctgcatatcagcattgtcgctgaccctgagtataaacgaagaagcctcatggtgacccaaacagagaattgttaactaagtcatgtccatagtgctttaccatggacaaatgtttttgatccacccttctaaggcaggggtagaaaagctgttgaaatgttgtaaatctctgcttgagtttgtgatacggttttaaatttagcagaaaaatattcaccaacaggagaatgagaaaccaacgtggataattattaatgttatcctgaacagaaaataaaaagacttgctgaaaaacctttctgcctggttttgtcagagttctcttccttttacacattcactttttgatgttttccttttgtgggctggcagaaagatgggggtcactctaaacttttactaaaaatactcttaaaactacaagatgtaagttctctattttaaagagcccatagccttctgaaaaagtcttaagcaaataaatgaaccaaaataacatgtgatcatgttaaactggaacacagccctgtgggaacaaagaacaattagccttgccccccaagatttgcagatgccatcatacaagtgatgatatttgatcagggtcttgagggatgagtagcagctggccaggggagaagtgggagagtgaaatttgaagcagtgggaaaaacatgaatgaagttgaagataagacgagataagaatacacatcagagctaagtaactccggagggaagaggggaagacccatggcgggaagagagacagagtggtaagatcaaaatttctctctctctctctctctctctctctctctctctctctatatatatatatatatatatatagctgcacaggaaggagggcctggattgtgaaggggcttgtgtatcaagctaagggtttggactttatcctgtgaagatgtctaatctgtttaagattttttggtaacatcatcttggtggcagtgaaaaggtacattagaggcaagaacattagaggcaagagaatatggagatctaaactgaggtaatagacacaggatgagaaaaagggagatatttttgagagatcatgaatacaacttagagactgactgaatgcaaggataacatatagggaggcaagttgggtttctggcttagagaagaagatgggggtgataatgctacctattattaaagtgttgaatttccaaggagatgtgagcagtttaacataggcttagcctgtcacttagtgatagggtgtggaagggagagtggtgttgacctttgtcggggggtacgtgtcatccactcatgggcatggtagcctgaaataggggcggtaaagaagggcccagcagggagtcagacagtctatgttgtctttcttgctctctcaggcgtctgtgttctttgtgtcattcacacgtgcctgtgagcgtgaacttgcatcatgcatcagtagttcccttagtacagtggttctcaaacttgagtgggcttgagaatcacccagagggctcattaaaacacaggctgctgggctccactctgagagatcatgattctgtatgtctggggtagaactcaagaatttgcatttcttagaagttcccaagtgatgccgatactgctagtccagagaccccattttaagaatgaaacactgttctagcataacagcccttaatcttctggaggtcatgaatgcctttataagaatgatggatcttctcctcaaaaacctgcagaaatatttataaacacaaaatacgacctattacttcacgggcttctgctactgccacctccacctccacccccgggacatacaatggattaatgaagacaacgtatccttccagtaccattttaaaggagaacccccaagaagaagaatacattggaaaatggcaccaaaatgtgattttacttatttagttgtcttagaattactcccagtgagcctacgtacaaaatgacccgatttggggaaggagacctgtcaaaggacagttcttgggtgcaatgaggaaattcatttcactctaaccacattcagataacctgaccttttcccattttaacctgccattcacttgggaagtaacaaataacagagaggtgggtgggtaaccatggagaaaagggtgcattcagccaggggcctgcctgtggaaggacggagcagtttgcacctcggggaaagcggaggtagggctctaggctctctgtctggtagcccagggaaacagttcaagatcaaaggaaaagataattaagaatgtgcttaaaagaaaacttcaaatcagctgtgctacacaaagatatgagacaatgcctgttgtagagaaaagagcattttgactttaccctaagaatctttcttatgtgctttccatagcccagcggtatagttatttttaaatgaccctggaaaggaagcagaggtgttctttattgcatgaatagaaggcaatctttcatttaaagaaccttaaccccgctctgcatgcatgcatgaagtcaggaacacaagggcaatactgtattattcattttggcaactataaattcaaatgatggctctgaggttggggagaaaaaggcccgctgagctggagagcagaacgcttccttcagcttatcaaagaagtgatagtgctacaggcaggagtgccccataataatctagggaaaatacgcctctgagtcaatgaagattttctgttattgcatgggctgttttgcctacagccaagaaaattctgtctgatggtaatgttttagctgctgattcatctcctctgtcttcaattcttctcagcaaacttttattgggtctcatcctgggcacatttacagagcaatttccataatgataacatctcttcaaatgagatttaaagtgtaattaaaaggcacatgtgttgtggcaaaggcgttgttgtgcagtgaccatacatcatcgtgccatggagctctcactcagccagcctatggaatgaccccggtttcactctgataagattccatggctttgtttgaggctaatggcttcattagaaaaaataaataaataaaagaagataaaacaagctctttattggagagataagtccatgaacatgcgttagacttctgcacccttctcccttcgttctgtctcttagaactcagaggcaacaagaaactccttgagcacggaagtgaacactaacaaacggacaggtgaaagctgaaaggatgtgcttgccctgagaagctgagctccttatgtcctatggcctactctcatggttttaagtgtgattgctagaaaagtggaaactacaggttacaattccctgaatggatgaatgcttgctcctgaaaaactgcctggtgcctgagaaagcaaggaaatactccttgagtagtcaatgtttgaaacctccaaagtagctaagactatttcttcttcactgtaaaatcaatataagatttttaagctttggaactactcaaacccgaaaatagcttgcctacccagatcctgactcatagtattcattaaatgatatgaactgattttttacttggctgctggttttaagtattgatagataatcatatcatatgacagggaaatcatattaacacatggggcgaataaaatctttcaaaagatcagttttgagatccaagatgatcattaaataatagattctgaagcatttaaaagaggacttggaacttttaaatgccatatgttcgatcacctttttaaaacataacatgacaatattcatggagactcaatatgccatgtaatgtctacgttacttacagcagagagttccactaattttctgtgctcctttctttgcctaaatgaactatttcatttagcacaatattttgtttgtagaataaaatttatccttgtgatgttgggagttatgaaataactcatgtgttttaaaatatcattaaatgtacggaattaaactataattagtagaaatcatttgagggtctttaatttactgatgctgacaaattctcatcaaatagttactgtgctttcaagtaaaataacatctttgtaggcagatgtaagacactagaaaaataatgtacactttcaaagagaaagtgaacctcccatacctctgaaataaaagcaatttagaaatctgatatattttaaaagaggcacataagttaatctgtaaatttcactttactcgttgacggtgaaatgctacgttcaatctgttgttacagcaaaaagttaatggaaagtttgacttcactgtaacaatatcctcttttaaccaaataaccttccttaaaccttggataaaattcccctgtttcacactatcaccatcacagataaacggattgaaaagacaacaccattctcagtagaactgtttgcttacactcagttagccaagcttctactacctgatttcattgccatggaaaatcctccaggataacttgggtagcagctacctctattacttctcccaacatcccactgcttccagttgctactgtttgctgttacaatcagtggtagcctagaaacttgaaccacccaagtgttttaaatgcggaagagaaaatctgagggaaaattgggaaggaaaaagtgtttccatgtttccgaagagcggcattgtgcttgtatgactgtttttcatcagctttgactttttggagaggcagttttacttttcatagctagtctaatatttcttctcactaaatagtgaattaacacagtgcaaatttagcagtcatccttttgacatctttactcataaaataagtaaaagcaatccccaacttacaaagagttctctaaccaaaaatcacttgcaaataaatggtccagaaccccaaactcaaatttccatggacacaatagtcatatacatgtctcagaccagcatatacatatatagctatttaacctataccatggatgatttatatcattttgatagcatgactttgggttatatgatttgggaaatatgcatcttttgggatatgaaagattcaagaagtacggaaaagaaatacttcctattttaagacctggatttgtccaacacccaacaaaggagatatataaatgggcatctgctctctccttccaccttctggtgcccatattttctactcccaaacttccttatgttttaatcctcattctcttctatctgttgaaaatcttattcccaaagtatagactgacaactttcacattctgggagatttttatattttaaaaagaggggctgggcatggtggctcacatctgtaattccagcacgttgtcaggccaaggtgggtggatcacttcagcccaggaatctgagaccagcttaggcaatgtggcgaaactctgtttctacagaaaatacaaaaagtagcggggtgtggtggcacgtgcctgtagtcccagccacttgggaggctgaggtgggagggaggatcacctgagcccagggatgtcgaagttgcagtgagccatgattgtgccactgcactccagcctgggtgacagggtatgaccctgtctccaaaaaaaaggggaagctgagttaaaccaaaccaatctgaatcacagattgataggatttccaagaatataagaatgcaaagtaaaaatattcagatggtagcataagcgtctgggggcagaaaggctttagctattcttggtaggcaatctactttggttaatactgtgaactggctcacctaaatctacttaccatccttccagttggacaggttggaaattaaaaactgtatttgccagacttccatgcagctagtgttctgattatgaattaggatataataagttagggttgtcagataaaatacaaggcacccagttaaatttaaattttctacacaatctttttttatttagtgttaagtatgttgcatgcattatttttatttgctaaatctggcaacgttttgccaaatgtgtatacttgtgagagatctggaaagtggaagtgaggcataggtcacctttctgccccttttggctatttctgttggcgagcttagtcaaagaaacatgagatttcctacatcagagttccaaagttctttctccagcttcctggctggagaagggcagttgctaacagcagcttcaaaagtggtagcgtctagatttcaacctcctggttcctagttcctatttacaaagtatgttcttgaaatcattgcttcagtggtaccccggagatggtagtttcttattggatcagttctatatagttttagaaatctgtcctcgaagccaagtctaaaacctgctactttagcctttccaaaactttgatatgtgtctaacgtacctagagtagtttctcttttctgcagtgaactccgttatattgaccttcagggccacctcctctatttgtttctactacttgcaatatcttcctttagtcattaaaaaaatctacaaacaatacaactttatggttttcttaacatggttctttgtcacagcagagatttcccatcacagaaggataggaattgaggaaggcaagtggatttgtacctatggagagatgtcttgttttatttattttatttctaaagaacatactttacaagacactttaggttgtaacagtgcattaaaatacctaaacagtataccagcatcctttaggaacactttactattatttttctcatctcttttgtccctcatatctagatgtcaaatttccactgacaagtaatttgatgcctagggaaaatattcgattcaacagtttcataacatgatgtcctattaattaaaacatgatacactgacattaaatttccaaatgaaaagaagcccagaagtgaaatatcacaaacttgatacatacgtatagtcacatggaggggtggagggatactaaggaaagacagtgtgttttcaaacctggcttgcacgtgtgaggtgaacactggagaacagaacttacctctctgctgtcagcacttggaacagcactgagcgcactcgaggcgctcaataaatcgagcttaattttttaaatcttttcgctcccttcgcccattctgcatatatctcatgtacaatttcatttcccaaaagtaccaggttctaacatcaggaagaaaatatatggtgagtattgaccatttctggtggtcaaggtctctactcttaatctcatgtaattagggtgatcctatagttcattgtccaaacctgaacacttttgagagtgtccaggatgctaataataatcacacagggtcaggcacactggctcatgcctgtaatccaggtgctttgggaggccgaggtaggagtattgcttgaagccaggagtttgagatcagcctgggcaatgtagcatgactcttatctctacaatatgttttaaaaattaaaaataaaaataaaaaaacagttaaaggagtttgagaacagcctggccaacatggcgaaactctgtctctactaaaaatacaaaaattagcagggcatggtggtgggcacctgtaatcccagctactcaggaggctgaggcaggagaatcgcttgaacccgggaggtggaggttgcagtgagccgagatcgcaccactgcactgcagcttgggtgacagagcgagactccatttcaaaaaaaaaaaaaattaggtgggcatagtggtgcacagctataatcctggctactcagtaggctgaaggaggaggattgcttgagctcaggagtttgaggctgcagtgagctatgatcatgccactccactccagcctgggtgacagagcaagactctgtctctaaaataaataaaataaaataaaataaaatatagtaaagtaaagtaacacaagaataacagggataaactgggacagccggagacaaattaggatagatgaacctatagcagtcaataaaatgggcaaaagggtctcagtagcagcagaggcagcctttcttcccgctcattctctccaagtaacaaaaggtctgtgacacgacgttctctttctgcctggggttcactgcacgcagtgaattgatcactgcacctgtttcttacattcagggaacggaaagcagagaaaggccagtggttcacaccactgtttgtgcacccaggtgccctctcaccgtggggagtaaacaccttcggttctgtttgctacggaaaagaaaaatgaaaagagggccaataacaaaatgcccttcaaagaaaacactttgtgagcctgtgtgtagcaaagataagaactaggacactgtcatgagaaagatcctagaatagcttcttgaaagaaagatttctttaaaaaaaaaaaaaaagaatgcgagtgaatgttgctacgacatctattgtgtattatctgccatatccctcttagcaaatgacgattaaagtttctgcatctgtcggtaatgcaaacgggaaagaattcactttcctgaaatttactttaaattttcctttacggagaaatgattcattccccctgtatttcatacctgatatgtaatacagattttatgtttaaaaaaatggctttgtggggctcccatactaaccaaaaatttcttcctagacatttctaactgtatctagagaaaacagggacatcaaaacaaaacaagaacacaacaacacagcaaaatcctggattttcaatttataaagtcatggatgaagaactggtttaaacctaaaatccataatcagagaacttcaaagagatatggtatattatacacatcagccttttccttttgaagaaaagcagagagaagacactggaaggggaaacctcctgctactctgggagctcctaagggctgggaccatatctgccttgtctgcggctgtatctcccacttccagcttgatagctggtatgcaactgcttttgctttcaataaagttatcgagtaaatgattggatacattaatacattgattagttatgaaagacatcaagtaccagagaacatcaaagaaggctaataatgagagtcaagcagtgggtaaccttggtatatacctagataatagagcactggtttctcttttttttttttttttttttttaattttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaacggacatgaactcatcattttttatggctgcatagtattccatggtggatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaagagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcggaaattttctcccatgttgtaggttgcctgttcactctgatggtagtttcttttgctgtgcagaagctcttgagtttaattagatcccatttgtcaattttggcttttgttgccattgcttttgaaaaactttgaaaaaaatttagaagaatgtataactagaataacgaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagtaaggcaggccaacgttcagattcaggaaatacagagaacgccacaaagatactcctcgagaagagcaactccaagacacataattgtcagattcaccaagttgaaatgaaggaaaaaatgttaagggcagccagagagaaaggtcgagttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaaggagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctatgcaaataaactagaaaatctagaagaaatggatacattcctcgacacatacactctcccaagactaaaccaggaagaagttgaatctctgaatagaccaataacaggctctgaaattgtggcaataatcaatattttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaactcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttaaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtactaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaatattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatggtttctcttgatagcagcccagtttactgtatgattgttttagccaccttttccccctccaatcttccaagttacagcagttctcctcactaccaaaagtgtgatggtaggactatagtttgccattgtcccttcattcattctacaaatactgagggagatgcagtgatgaacatgacagacactgtcccagtctaatccggggttttctgttataaaagaatgatatcagggtttagattaggtactctgaatgcaaagccctttgaaagttggacaactctgaacacatcagggatcctagtacatgatgaacaagtatctgagagaattttcttaatttaacacctagaaaatcagctaaaagggtaaaactgtttgcacagaaaaccaaaccatttaagaagagattgaatagttattagattcttttgatcaggtagaaaacctatcctgggagttaaaatctcaagataggctcttcttggcctataatatctatttggactagtcacatggcctgaaattaatgagataattgaaaactatcctccactagaatctcctcattttatgcattttatgcaaggttgcttagtggcctaggattgataataataagtaagctaatgaacccaatcccaaactgattttgcagtatcttttatcagtagatttcatggcagttgctgtatatttaattgtaaaaaattcgggactgtttaaactggggaggtgagaaaacagaaggaaaagaggtagaaataagaagcacaagaagattgtgaaccagttttcataaacttagaagcaatgaaaggtacttgaaactgcaaacagaatagagtggacttaaaactgctcactgattgtgtactcaacattttctctgttaaataggatcctagagcagctatttcaaattgccactcaccttaaatctcagactccaacaccttcctcatcactgggcatttagctgcagcttccacttcaataaaaaataaatccaatacaacaatcctacttaacctttcaccaaacttacaaaactaccagtagctatgcccatcctccttcccttctcccctgatgttgtaatagaagctgtactttccttcctatctgaagctaatttctaaatttcatctttctgccttctcaagtacctgtgctattgattatctctaatttctcctgcatcctcaacctctccctctctaccatcttcttctcattgccatttaaacatgtgtaagtcactacccttttaagagtgtgttcttcctgcccctacatccatcttctgctactatggccctttctctcttcccatcgcagccaaaagtcttaaaataattgttttacacttgctcccccactttctcaattctcaatcatgcctgaacgtactgcaatcttggttctttagttaccaccaagtaattactgagttctccataatcaacactgaaatcacttgcataaaggttgtcaataccttccttgttgctaaattaataggatatattttggtcttatctttcatgatgcttttgtagtatttgacacctctaaatgttactttttcttgaaaacctctcttcccttggattctgtgacatcacacgaacctagtctgtctcctatctactgaactgcaaatttccctgtctccactgaaagcttatttttctttatttacccctgaaactttgccattttcctgggttcactcctaggccctcttctcatctacgaactttactctgaaccatttcaaacccttgcaaggttttaattacgtatatactgataattaaatatccaattaaagattctctagcctagaacatttctccataggttcagctcacatacctaggtatcacaacttagttacactatcatcattactcacctggacaatttcaatagtgtgctgaagctatcttcttgcctccagtttgctaagcttcctctagtcccttgaaataacatgacatgactttctcacttccaggcctttatgcatagtattccatctgctgggactccacctcctccaaatccccaacttgacctgtctaactcctgcttctcttcaggtctcagctgaggtaaggcttccttgggaaagccttctgcatcctgccaagccagggtcaattaccttgatgtacacccgtagcactatcatagtaatacccttaccatctataggttgaatatctcatatccaaaatacttgcgactgaaagtatttcaaatttcaggttttggaatatttgcattaccctatggatatcatgcaggcctttagggcattttcaacaatatcttgacaccaccagagaatataccagcaaacacagtgattaatgcacgtaggttttggccccatgctggacattgtagggtacctgccgttgtcgcgtctagcccgcacatgtgccatttttcgtaccttttgtgggtttgcttgtatgatggaatctgggtgtgggtggaaaagatatatcacagctaacgggggctgagaggatctttcttcccttggggatgctgaataaactctatgtggtgtgcctgcattttcactgtgacttgtcacatgaggtcagaagtggagttttccatttgtgatgtcatgtcagcattcaaacagttttggaatttggaacatttggatttcaggtttttggatcagggatgttcaacctgtagtagttacttgtttaatttccttcctcccccactaaactacagatcaaagaagatagagatcaaacctatttcctttatttattgatgtgtctctagtgtctagcctaatgtttggaacatcaataaatattcatgaaagaaatggataaataactgtatgcttgcaccagaagatatcccacagcagtcttttctaatccttggtaatttgaattttttgtattattgatttatatacaagggctaatgtcctgcgaagtagtagtacatatgtttctgtttttaaaagacattgtttcataaaattctattataatgaaaagcatgggctattacatttttccttcatggagatatttcttatatatcgtaaatctagaaatgtgtattaaattagacatactagaagtcaaagaactgaggtacagctatttagaaatgaatttgtggaagcagagggccatgaacagctgtgcaagttgtacaccgagaaaaacaaagaagtaccattcacatcatgagttgtatgtttcacaatctggacggctcttcatggcagtcctgaattgtagtaaaagagaagggttattcgttctcattattttttcctcagactctctcttcatggtgagggatgattattctcgtattcttaaatttcagtctaatagagttattagaattttaaagctggagagtatcttaaacatgaagtagcctagagatgacaaagaggttttacctatgtgctaactctcattagtgagtggtagctacctggagcattgccttgagaagtgctctgatacagagctgactgactagccatgtctttcaggggtaaacgagacagaaacggaagccattcacgtattttccttccttgttccagttaatctattcattttccagaagagaaaattaaggtccagaaaagcaatgcaacttgctcttaacatcagtgctggagcagaacccaggtttctgtacttctagcctacgtcccttccttcacacctggtttcaagattccttaaagataaattataaattctagccctaagatttgctgcctttcaaattttaacctattttcaaggttaactacctgcctttggtcaccagcataaataaatctggatatgccatgtgagaacacagcatcatcacagcaaatagtctttagcatcataaaactatcacataaaatgtagtgccaagtgcactacctaaaaggcacatgttataagtagtaggggtcattgtcaatcaagttaagcaatgcaggggggaaagaaattgtcagaggaacaacgaagagatcatctgtaatatcgttttgagacatatttggcttgaatctatacaaatggcagcagaatacttgcaaggacttttgtcccagtgtgaagaggtaacaactggaattgattcaacgtctattaacattggtcatggtgctagatactgagaatccaccagtaaacaggaaagacatagtccctatctttgtggttggttacattttagtagagaagtgaggcactgaacaatgatgtgagtgttttgaaagaggaagtacaaggaacttcttaggggtgggaggggtagccgatgaccccaaatttttgacaattgccactcggaaacagaatatagagatcaatttgtgataactttctgcagctattctgcatccaggctggatatccaaaacaaacactggattgctggaaaacttaggaatttaatattcacaaatcgatattctaaaataagtaaaaacaattagaaaagacagattcacacagagtaataaccatttgaatctcaatagatactagttataaaatgatacggacctttaaatcagtacatcttctgatgtctaaaagatgcttatcactactcactagactctttttcacttgctttgcaaatcagtttaaacatacatggtaatcaggagtcattatttttattcacttggaaagtcagaagtaccttttcccagtgagattttgaaggaaaagtaaaacacccttcatttggagattttatgggtgtctaaacatgtgcttttctaaacaggaaatgatttatgacttatcaaaggatatgcctgagtctctcacctaatctctaaacccagctgactttctccatttctctaacactgagcgtagcaaaaggagacgctcttgattagccaagagacactgctgctcatacaccaacctatatttgactcagggttggggaattgtgaaacaacctaaatgcagcacttttagatgaaaattgctctgaggattttccattctgaaaagtagaaggaaaccaaggagttcttataataccagaaaacttagaagcccttaatgcacaatattacactgacctacaaaatgaccttcgcacaaagttaacttattaagaagcaaggaaaataggtagaaaggcattgttggtacaaatagaaacgctgctaaaatgccgagtctggaaaatttgaaaaagatcttaatttccaaaactgtttctgctcagaaagaagtaagaggaatatcatttggtgatataaaacttggcccttttgagagtgtgggagaaaatgggtggagaactattgattctgacataatcactgcaaattttctacactgtcattgattaatttcttcaataaacatcgatttaggatctactgtgttctagggctgtgctgctctgtctaacacaggagccactggctgtaggtagctaccgagcaattgaaatcaggctagtgagacggagagactgaagtttaacaaatttttattccattttattaaatttaaatataaatttaaaaattgactcttggttcagttattgaaaaacttttgtgtatgtttggaacaacttaggaatgtgaatcttcttttttcaactataaagtttatgaaatgtaaatagagaccaaatattttcttttttttttattatactttaagttctagggcacatgtgcacaacgtgcgggtttgttacatatgtatacatgtgccatgttggtgtgctgcacccattaactcgtcatttacattaggtatatctcctaacgctatccctcccccctccccccaccccacgacaggccctggtgtgtgatgttccccaccctgtgtccaagtgttctcattgctcaattcccgcctgtgagtaagaacatgtggtgtttggttttctgtccttgtgatagtttgctcagaatgatggtttccagcttcatccacgtccctacaaaggacttgaactcatcctctttatggctgcatagtattccatgatatatatgtgccacattttcttaatccggtctatcattgatggacatttgggttggttccaagtctttgctactgtaaatagtgccgcaataaacatacgtgtgcaggtgagaccaaatattttcaatgaaaatacggtgtccaaattgagatgggatgcaattgaaagacacatgccagatttcaaagacttagaatggaaaaagcaaattttattaatactttttattgattacatattgaaataataatatgttggatatatcagggtcaataaaatattagtttcacttctacttttaaagaacgtggctactagaatacttaagattacataggtggctctcatttctatgggacaacactgttctggacattgtgctggcattgggaacataaaactaaacattcccttaaggattttacggaatggtggtacatttactgctatagcagagagatatagaggaatgcaaaggacgctatggggacatagatgagtagcaattaaattaggctgatgtcaaccatggctacctaaaataaggcatgcttaaattgatccttaaagtttgagtggaagttagatgaagaaagacgaagggtattccaggaagacggaatggcatgtacgataacattgggagaagtagtacaatacagtgattaagaatctagaacctctaccctttgagtcatatgcactcaagctgtaccacttactatctgtgagatcatatgtaaattacttatctgtatctctttccttctctgtgaaatagggatactactactgtcaaccttataaagttatcgtaagaaatgcatgagttaatatactgctcagaactgtgtctggtccacattgtatttcctgctattattgtgaattagaaaatactcccacaggttggagtaaagggaatactgtctgtgaaagtgtcagggaagatggggctacagaggtgaccaggcatcatgcattcaccagagcagtttgaccttttatccttcaagctgtgagaggattagtcacatcttgaaaacatattccaggcataagagtagcagagcatttagatggatctaaggcaatagataagagataagaggccaatgcagcaagctagttgagcagtgctgcggggccactgcgaatagagggcagggcatgaataaggtggatatggttgctaaatgctcttgaaacctttctctgcttctttttaggtatctagctagacttcattttccagcccctctgctgttacatgtggccacagggcagagttctagccagtagaaggttgagtcaaaggacatgggacgcctccgtgtgcagtcctctagctcattcccctttgggctggctgaatatcttcaggagggcaacctcggcaattggctattgcagatggaagacccttgctggcctgttttttttttaatttattttttattttttatttttattttattttattttttttagatagagtcttgctctgtcgccaggctggagtgcagtggcatgatcttgtctcactgcaacctccgcctcccggcttcaagtgattctcctgcttcagcctcccaagtagctgggattacaggtgcccaccaccactcctagctattttttgtatttttagtagagatggggtttcatcatgttggccaggatggtctcgagctcctgacctcaggtgatccgcccaccttggcctcccaaagtgctgggattacaggtgtgagccactgcacctggcctggcctgtattcttgaataattatgtgggtgtcacccctcccttcccacacacacatccaacaccaactaacatgaattcaccttagactgtttacatgagaaagaaatacatttctattttgtttaagtcattttaatagtccatttggtggatgtttaatatattatagctgttagcctatcttagctattatagatatgaaacatacttaaagagctaaaagcatttttacgaggaaaaaaagacttgatgacagataagatatgagagtgatgaagaaagttgtcactaaattctttgagtagcagggcctcaagtgttatcttgagtgcaaatataaacagtgaaccgataagtatgttcttggtgaactcgccaaagtaaattttcagccagcaatgaacaacagtaagaagtaggaatttggtgaggttaaagaaatcaggtatcttcctcaattcagcagaaaagaggtcaagtttcaaaagacattgggaagtgtgggtgaccctcaagaatttagataagaagaggaaaactgtcagagtcatttggttaaggtattgataagattcaagctatgcggctgggtgcggtggctcagcactttgggaggccgaagtgggcggaccacgaggtcaggagttcaagaccagtccggctaacatggtgaaaccccatctctactaaagatacaaaaaatttgccaggcatggtggcatgtgcctgtaatcccagttactcgggaggctgaggcaggagaatcacttgaacttgggaggtggaggttgtagtgagccgagattgtgccattgcactccagcctgggttacagggtgagactccgtctcaaaaaaaaaaaaaaaaaaggattcaagttacgctactccaaaatccacaatatggcagcttggtatttgagaagacagcagaagcaggatggtcactctcaccttccccttcccccttctcccctgaagcaggtcatgagactatcataccagaggtgcccttactatactggaaggaaaggaaaatttttacctctgaaaacacagggacacaggaggttctgcagaaacaggccttgctgtggtcaccccagtttattaccattcccctttgtccagtcatactggacatctacttttcctcaaatcagagcataaaaatacacacttttccctgattctttgggtcatttctgaaggctcctgtgtcatgtgaaacttatattaaataaattcgcatgcttttatgttgttgatttgtccttcattataggtgcctcagccatgaacctagcgatgggtgagaaaagagatcttttctcccctgtaagagtcaagtagattctaaaattctaaacaagcaggtttcgggttctcagaaaacagggggttgacaagaatggttctgacatagcccaaactgtgaaaactgaattatgattccaaggcaatagcatttaatactcatgcttgttgaataggcaagggcttccagaaggaagatcagagcctggtcttttcatctctggaaacctagatgtggtttactcttagaatgaaaaagggctaagtcttcctggggctctaaggactctccctgtgttgaatagaaaaagggataaaccttcaactgggtttgtaaaatatcgttgttccatggaatcaaattcaagaccaaggtcaaaagtgatggtcacatcttgctttctctgaccctacccaggatcagaaccagagccttcagctggcagcccattccttctgctgctgaaaccaatcctcaccagccaggcaattcagcagaagctcactcagggacagcatggaagaggcgtgagatgaatatcgctgctgccattctgttaaccggtgtgagctctagacttcatcatgattactatatttccttctgccttctgggattccttctgacacttgtttcagtttaagaaccatgtttctttctcaaatcattttccttatgctgtttcttcacaggaatgatacacttttctcatcataatttttgaaaatatgttgcaaaaaaatactgtgtgctatctgcagtgattattctttcctttgccttaaaaagaaagtattctagggaaaggatggaaaacaccacagaagttgtgagaatgggcatttgtgatttctaacaaggatttgtcagcctttgactgctctggactttaccagccacagttgctgaagacatgcagggtgaaagatcagcccttacagctctaaatcaatgaactccttaaacctgcccccaaatgtatcaggagctggaccctccactagcaggcagggtctgagatttccttgagcactcactatgtgcgagttactgtcctaaataagtccagtgtagtaattcacttcattctaataacaaccctatgaggtcattaatcttcactgcggatacaaagaaactgaggtatatagaggtgactcagctagaatgtggcagtcaagttacaggaaatttataccattctttacaactgcctttcctgaagtaatggctgtgtataatattgttaagattgggtcgacaaaaatcaaccagtcaaatattagaagcccaagccccgccaacagatggattcctgtattagatgattttcccgagtcttctaacgacaaaaacagcaatggcagcagcattatctgcaaatatttatgagtacttaattgtgttgtgccacataccatattaagtggtttccatgtgttaaatcaatgtaatcccagtatccagtgggcgtcagcagagctgccttgagctgcaacctctttcattagcaaccagcttagatcccttagtcattttggctgggctactctggtggtgattcataccccagggccttgcctgagctgaagctagaacgtggctttgcaccctggaaacctgcctatattttgccagttttctccccttaaggaactgaaacctagctggtacctaagaattgcttctttctaaataaagcctactatggccacaccaccttcccaaactaaggtgctgaccgatgctctcctctccttctaccagattccaacctttagttattcatattttagtcatttcacttaactttacaacttcctcttgcccactgattttggaatagctggtttcctttcttgaagacttgaataccaattaccagggcagccctctagcctcctgtctccagcagttagctgctacagacattatgcttcttgtcagaggcaatgtgggtcatgctttacctctaaacagaatagccccctatctatgacatagaataggaaatgcctgcaggcagggatctggtcttattaatcttcatatctctaacactctttctgttcttagcacatagactattcttaatacgtgaatgaatgaaggaatgaagaatgaatgaacggctattgaaagatatcaatcttcattttcctttcccactgttaaaaatcaaagcgataactcaaatttccaattagaatgaaacataccagttctagttggtattctgacagaaaaaattatactgcaggttatatttttacactaaaattttccatcacgtaactggaattaatttattccaagatagtagaaatgtattggtgcagtatgaaatgaaggggatttaaataacataataaaaagaagaacattacaatctgtttaacataacctaaccctgggaagattaatagctttcaattcatacaaagactgaagtctacaatttcatatacacatggtcttattaaaaatgaaagctggttataatgaaatgctagcaccacgctaagattggcatggtgtatgaaatagacaaactaacagtgtggcaatagttggaggtggaatttcataggataactttttagttccaaaatggtcaaatcacacaatggctggagatataattaagaattaggctctaaaaacaaattctgaaacagaaggtaattaatatatcttcggggaaagctggatttttaatgaatcagacatgaccgcagagaaaggctcgatgttgccctgtactctcttagtctggttagctaaaaccaccccacactagggacctcctagtgcatggggttaaatttcacatttgtgagcagtaagcatgtgtttgctggcactcttgcagcatactgggcatgctgtggaaggatcagagaatttttggaattgtgcactaaatgtctttgttctatacagttttaaataaatgagtcattttcagacttggagtttttctttaaatctgttggtataaaatcctattttctaaatgaaaccatactcaaaagtggaatatatgaaagagataaaagatgaaagtattcaagtgggttagggaaccttggaaagagcccattcaatccctcttcccatctctccctttggcctctgaggcaccttgcagaactttctagaatgacttgaatggtttgcatggtttgaattcgatttgcatggtctgaaagcctccagatctggagcaacactcatacttttcaggtgaggtaactgggatttaagaagttcagggatttttgcaaaatcacaccgacaagtaaatcagttgagagggaaggaaccagagtattttcgtagcaccaggtcttggggcttttgacttcaatttctcattgccctgccccctggaacagtgccactcaatggttcataggttgccagcatgagtgtcatcacctgggagctggttagcaatgcagaatcgcaggccttgccacagacctgctaaatcagaatctctgtggtgggatccagacaactgcattttcataagcttgccaggtcattcttaagcatcctcacccttgaacatctttcccgtctttccttttcttctggtcatgattcctcaactcccaagctcaaaagtagtgaaaatgttgttataaaggaacagaaaaaaaattaggagaggaatagagagtgaaattactccagagcctttattccctcacctcaggtcccactgaagtcattttggaaattatgtagctttttctttttcttttttttttttttttgagacagggtttcaccatattggcaaagctggtctcgaactcctgacctcaagtgatctgccctcctcagcctcccaaagtactgggattacaggctgcgccactgcaccaggcctggaaattaagtatctttgtttaatgatggcattatgaaaaagactaatatgttctgccactcctcttcccggttacttcagctttttttaaatgagtaaactagaaaatcattttttttcaaactaaatgtcttcatgtttatcatgtaacatttgttatgtaaactcattgtttaaatagaaggactagggcgtgcaacatttggccacaaaagaaaatatgcacacacacaaacataactgattttttttaaaaaaaaaacatgtattactttaaaaatatgccagttaaatgttaaaacttatgtatgaatgtgctaaacaaagagactaacacaaaataatttctggtaacatttttagtatcatgaaggcccataaaaatgaggagggtatggattattgaaattgtgtgaaattagaaaactacatagaaacattcccgtgaatgcaaggagacaaagagagcaaatagttaagtacattggacccctccatatctgctcctttaaaaaatgtatatttcagtcatttacattttatgttaaattattatctgactcttctaaaagtttttggtgtaaattaaagatgatctgaattatcagaaaatcaggactgagaacaactaccctgaaaaaaaaaaatggattactttagaatgtgaaagaatggccaaggtctatgcaaagttatttttgctttgaatagaaaccctgagtgcaatgtttaagaatataaacctattcccaacatgcaaaaattctatagaattcttcaaatgaaccctccaagtcagtattttaactctgctactgtgtatgtgctaggtttcccaaatggaattctctattcccagaacaatcttttctaaagccacaaaaaacacaaatagaattcaaagttcttatgcttgatatactttatgccttctttcataaaacacatcacctagttttcacgtttctctgaatatcctatgttgtcacaaaagatatatttctcctaagttaagctaaaacgcatgattttaagacaacctaaatgaaaattgcaaacacaaaacacattcataaattcatgcttatgaaattatgacttacagcataagttattcttgatatttaaaagaatcgtttatgagtttttgtcatcatgaatgtttgacaacaagattatctgtgaacaagagattgtgtgggcttacacagtattttcaactaaaagttacggtattttgtttaacacagaaaccacaccataggttaagtttgagattattttgaaatatctgaactactcagcaggtaaaaacaaataatacagcccatttatagctcatcagttttttgttttgagtcatctaagcaataactcaaggaaggtgagagagagcatttgccaccctccagggtggcaactgaacttcaggaattccctggagatacagccaattgatgcttcacatctctcaccatgctctgccatcaattctccattgccatggaatccacaatggaaatgtgccacacttaggccacttttcatttcagttcttttatatattaccctcccttttcatattctccttggaactgaatgagttactgtttcaaagaatgggggccctgtactagggaagggtggggtataatgacaagcaagttcatttgtttggaataaaatagtcagcaacagaacaataaacacagaagtctgctagaagaggccttcagtttatcaacacaaagagttttcttcatgacttccttggatgtcagttgcatttaaatatagagttgctaataatttcctttcctctttactcgtttaattatgcaatcggatattaaagcattgggtcaggtattttgcccaattttagctattttatttgtattttaactatttccaattttaactgttcttgatttatatccaatttatttccaatttatattggaaatcttggccagtaaataatttgagtatagcatggtttaatattataaaggttatatatacatacacagtctctctctcccatgtaactatatccactaaagtcctaaagtaacaatgcctctgtctgttatggtgactcagtctgggtttcccatacagcagactgaggtgatcctaggaaacactgtagggaacaggaaaggaggagaggaaaaggaagaaacaatccagagttctttattgggctgggcgtggtggctcatgcctgtaatcccaggactttgggaggccaaggcgggcggatcacttgagatcaggagttctagaccagcctggccaaatggtgaaaccccatctctactaaaaatacaaaaattagttgggtgtggtggcgcatgcctgtagtcccagctactcaagaggctgaggcaggagaatcacttgaactcgggaggtggaggttgcagtgagctgagattgtgccactgcactccagccagggtgcagagtgagactccatctcgggaaaaaaaaaaaaaaaagaggtatttattgagtagattactaatctggggaactggggctcaatgctgttggggatgctctgaggatctttggaatatatctcaaaattatcccagtgaggggagagaaagctgagatttgtacccatctactctcccttattggttgagtcttgctcctgttaataccctgtcactttgggcttggtccatgtgcccatctaccaccccaaagctaagaggacatggaaaggatacctgcagcatctgttctacatggtatttgatattaccctcaatatgtgcccacaaaacagtatacaggatcatggactcaaaatgacagcaaaataaacagatgcacacactgttcacaaaggatttgattgggtttgcaaagctccctacatttctttgcatataaactagactcatcccttaaatttcaaagtaaaatctcaccaactgagcgaaagctgtggcacagaagttcctcagagttttaaaagatgtgctttgggtttaattccaaccacatacatataaaaccatgtcagtttcaaagtctaggtcagggctcttaaagctgaaacagctagactcaaatctcagagcattttcataactggatgatctgtactcacttgcatttgcaggcaaaattgtaaatgaggaattacaatatatacattcagaacagagaagaaatttccctaaagacaagtaccaaaaatgttaatgtaaagatttgccacttaagaacaaatggaaaaaaaaatcattggtgcctaactttcgacacataatctaaggtctgaagtctttttgtgtttcacaatatgaaggtgccctggccacaatatttatactattcctagaagattgtaaatagtatctgaatgtgcactgtgagtttctcagattcaaccccaggaacaattgcgcaaatgctctcctgcatatagaaactgctagatcctcttttcagagctgctgctttttgtttttctggagacagggtctcaccctgctgcccaagctggagtgcagtggtgagaccacggctcactgcagcttcgacttcccaagctcaagcaatcctcccacctcagcctcctgagtagttgggattataggtgtgtgccaccacacccagctaagttttttatttttattagagatgaagtcccactagattgctagggttggtcttaatttcctgggctcaagagatcctcccgcctcagcctcccaaagcactgggattacaagtgtgagccaccacacatggcccagagctgcttcttaccaggcagacagagaaatgggaggcagcacgaccttggagaaggaggaaatagtcattgtccccttcttttattagggagtgcaggccccaccatactactattctaccagcacagtgcctgctcctctgggctgctccttccaacctcactgctgccctcagcctcatattcagaacatttcagtggtgaagatcagagcacataatgagcttgtctggaacaaattaagattccgggctttaaagtcaaacagacatgggttacatgggtttgagtctcatttggctctgcgatcttcagcaaatttcttatctatttccttatccgcagaatggagatgataataccaccttcctcaagggacttttgtgatgtatatatagtgctgggtatttagtactgaaaatatgctagaggttgctatttgtagtagtagtagtggtagtagtagtagtatggaaagaaggaagcaagctaccgcacagaagtctcctgaaaatctgaaaaaggcttggggaaatccagcagagagagctttccctttcttcagagcagaggtttttaagttgtgattcaagggccggcaacatcccctgagaacttgttagagatgcaaattctcaggccccatcccagaccaactgacacagaaactctggggatggggcccagccagctacgttttaaaaaggcattcagaagattccattacaggtcaacttttgagaagcactgctctagcggaatagcaggaagggtaaatgctaagctgagcttagttcatatgggacgttaacatttcctctctcattagtggtcccctcctgggcagatctagcatttgagattttcatttacatttcttacttatataccatgcagtcttgggtagggcccgttaaagatggaagtagataactattaggttggtgcaaaagtaattgcgttttttttaccattaaaagcaatggcaaagaccacaattacttttgcaccaacctaacagctgtaagggattatttgttctctgtccaaaaccagaaagactgactagaaagacttttacaggccattttaagtccttgtttgttttaaatatgtacatataaaaatcagtatctatgtctatataagcacttcagtgtgttaacaatcatataatcacgcccatgagagtatcatgtaattgacattgcaccatcattaccattatgttgaaaaggtgagcaatagctactctttaaatctacttagaaatcatacaggattgtgtggtaaattctgtgtattaacataaagtcagatttcaaatcttaaaggcttgtagaataacattttcacagccatatggttaatagttgtaaagaaaagacaatgtttttttactgctgagaaatttgactacagaggactcttaagtattgtccttcatttagaatcttaaacaatatcattacatatgtccttttgattttcaatgaatacatatttacataaaatgtagtcatttctcccacttcttcattgttgaaattgccttcgccaacagctatgcagtgtcaagatgggatcagaatgtgtgggagcagatatttttttcagtcatgctttgctgacatatgcactgttaacgaattaccactgaaacaatatatgtgtctaagaaacatgtagaagagctggctgttaattcttatctatgcgagaagaagagaatatgagagtaagaagaacttggtttgttgagactcaactttggctaaattggaatcattaaagattaaaaacaatgatatctgggttccccacaaaagtctgatatcattggcttggggtacagctggggcatttttttaagcttccaagatgatgctaatgatcattagcgtcatttccttataggtcacctctaacctaaccacttcacagtagttaaatctggctatgatctgtactagctggtatctggttgggagaatcactagtactgggtttttgtatttctgcccagccaggcgttgatcatattttacattaggatttgcataaaagaagcaggccaggcagtggccctatgttcctttccccacacaaggtcatacataaaatatattattattttttattttttccccctctggccttttccctgtaagtatatgttatcactttgatacaaatgaatcataattgaatactcattcactcactccattcacttacttattcattaatgctttcattaaatatttattatgtggtaggtatacggaagtacaaaaaagtacaaaaagacctcacaaagcttaagatctaaacaggaatacaaattcatgggcaattgaaataccatatggcaaagggtaagacaaatgtactgaagtagcacattgaaggtgcaggagatccggtttgggatgttcaggaatctatttatgaggtgctgtctgaaaagggattattaactagctaaacaaaggtgatagaggagagacagattgttcctaggagagggagccatttgatggagggccagaagcaagaaacaaagatattttatttgattgtagagttcagtaaagagggataaggcttgagtggtcacacggagtgagagcatgaagggccatgtaagtagtggaatgctagtaaatgtcaaataactggctctaggggagggcagtggcgctaattgtagcatttgccaatttctgtggtgtaagtgctctcacaatagctgatttcaagcaactaacttgatgtcattgaatgaagaactcagtggaaagagatacacataattggctcttggaatgtgttaattagaagataagtagttagcaagcagagcatgtgtgtactaaacatagatagtgagggatagaaggaccaaaagatacccaatattcatgaggcacctgggtactaaatattcataatatgctaaatacacatgagaccaaatatacaagaggcactaaatattcaagatcaaataaatacacatgagcacttaatgttcacaaggtcttaattcaggcatccataggtgatacctattccagcaccgtaagtcttctgcctgagaattacatggctagtcatcaggctattttggcaagttacagctgtggccatgcattcttgtctctgtgtctctgataaaccacatgccactgaatcaggcaccacccattttggactcccttgttgggaagtcaactttggtccttgtaagcacaccataattgggaaggctgatgcaatacagagacagacaagacatataatgttgtgtactgcagaattcaagtactctaatcttcacagtctgcttacactctattctaagcgtgttaacttagcacatatctttcccgtttgcttctcactgtgattttaataaactctgtgattcaagtattttaatttggtctatgagcctttctgtttcatgatttggataggctgcctggtagtatacttgaaggccatcattgcatttaagtaattccccagatgacagaggaagtttatcataggtgaaattttaaaagatttatgataggtgaagtttaaaaaaaataataataattggccgggcgcagtggctcacgcctgtaatcccagcactttgggaggccgaggtgggtggatcacgaggtcaggagatcgagaccatcctggctaacaaggagaaaccccatctctactaaaaatgcacaaaattagccagacatggtggcaggcgcctgtggtaccagctgctcgggaggctgaggcaggagaatggcgtgaacccaggaggtggagcttgcagtgagccgagatcacaccactgcactctagcctgggtaacagagtgagactctgtatcaaaaaaaaaaaaaaagaaaaaaaaataatagtaacttaaatttttcaagggggaaaaacacctcggagttgatgaagatcattcgttgaatttgcttaatcatttgctacattttaaagaatgaacttgacttcctgtgaagtgaaaaaagcaaaaaaaaaaaaaaaaatcttgaaatggattgacttctgaaatgatttgtgaggccacatccagaaaggaattgagaaaaagtctttaaatatatgatcaaagaaatgttgaattaaaaaaacccaagcatcatattctgatgacacttgctcattttcacacgttcgttccaaaaatattaaaaaacacaagagatgaatcatttgatgacatttaaaacaatgcaaaaataaatttagatctaaagtgtcattgaaagacctaattggattagaaagttaatatttaaataaataatattcagaaacagagaggattatgctctggcctttatttcaatgtatgttatcagtaaatgccactataaaattaaatatgcaatttggagaaatttaatttaagtttgttgggatttatttactgcccatttgtttaaaggcattctgctagatactgcagggggctacgaagatgaaaaatacattctcaggactttacagtctaattacaactatgaagaatgttctccaaagctctaaatacaatttagtacaaataaagtacaaataaaaagctaaagaggtttgaagaaaggagaaacatagctgctgggaggatcgggaacagctcatggttgaggagctgcgggagacagtacttcaataattagggtattggcaggcaaagagcacagagaaagccaagaaggccaaggccattatatgacacggaacttagatgtgatcctataaaaggcaagacagtggctcatgtggcctgtaaactcttttgaataaagaccccaaacttctatgggtaattactatgctagaagcaaactgtctcagtatcctctcaccccaaacatcattattaaactgatcatgaggtttcccagggcaacattggaaacagagtcatctccagtctgggtatacagacttatgcacaactgtctgttttaacaaggaatatgttgtcgtgtgactaatttgcccatttgtctccccaactacactctaggctctagaggccaagggttttatcattttcatccttaaatctagcaattagtacattgtttaacacttagcaagtgctcaattaatgcttattgaatgaaccaacaaatctatcaaacaatagtgcatcaaaatgtttgctccaatctgcttattaataactcagtgtcttggttgccaaaggaggggaaagagaaagggtagagtgtagtagaagagggggaaataagattctaactagcacaatgaacagatttgagttacatatgtacacataaaatcggcatagacgtgatactcacatacaaatacagattggaaaaaaaaaaaaccccactgggctacgaggagtggagttgccaccattccctgctatatatcccctctagctggccttaggtgacttctcctctctttcaaggctcctttagacattctagaatgaaaatattgcagaattggaatgagagaggcatactgtttgatttactctcttagataaagcctgaataatttcgcttataacaatgacagaaattattggaagataacaaagtgtcatgtgaattatctaagaaagataacattagggtggaatgaagagctctgaagagtgccaatatatgaataatacacattatatggagaaagccttttcttttttggtgaatacatgattgagtagaattttacgttgctggaaggtagagtttgttcttctctctatgcatatatacatggaactagtctccacctgagagcttatgacctctttctctctctttggtgttgaatatgtgtgtatatgtgtgatactgcagtgcttctcaagctgcaacgtgcgtgcagatcccttggggattgtcttacaatggcggattctgattcaacagttctgaagtggggcctgggatttcaaaattctaaaaaaactcccaagagatgttgaggcttcaatcacactttgcacagcaaggtgatgctcttttaagaaactgaagcaattactaacaaataggtcacataagtatgtaattataacagaagtgaatctgtgcacaaaagaaagaactatgaaagaattatgtctgagttatatgtgtatatatatatactatatatatgtgtgcgtatatatatatatggacatataattggcattattattactgtgatagaaagacctctcttctgcaagccaaattatctttcactttgttgcttcttgaattcttttcttcttttttcccctacaattgcatctccagatctccttgaaagggtcaagtagaatgcctatgggctatctaactatgttggtaaggagtttgaattcaatgacattcaatgcatatctaagccaagctgtcacaacacactcaagcctgccaaaggagttcgtacaaatctttaaaataatttacaggagagacaaaattaccacatcattcccattatcagaagaaataattcaaattaagaaaaattagaaataaaaatgaagagatgacactgaagaatatctcaccactggaagatgactttcatctacagtgatctctctataaagcaaagatacttttcagctattattcagtaagtgagtccaacagtttcctctgatattgtgaatttaattagtaggcaatttgctcatgaaatcagaatctagcccttcccttgctgggttgctggatctgtgtattcctatattcttctctagctattgcctcatttctcaaattcctttcatgtcttcatctccattccttatttccacctccctacttctcaactcaccaccataagacttcttggctgccgggcgcggtggctcacgcctgtaatcccagcactttgggaggccgagacgggcggatcacgaggtcaggagatcgagaccatcctggctaacacggtgaaaccccgtctctactaaaaatacaaaaattagctgggcatggtggcgcgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaagacttcttggctctggttccagtgtaaattctttgattgcatcatcatgaacctcttacttgaggttagggctcagcgccccgaaccctcacactgtttgagggtcaactgtataacactttccctaattcccaactcaccacaataagacttcttggctctggttccactgtaaattctttgaggcatcatcatgaacctcttacttgctgaaaactccaagaaatagtgttcacacctagctttttcagctgcctggtagtccctgacactgccagccacttccttgtctttgagactttctccttgctcaggttcctagtcattcttctcctttgtagcctgccattttctggccacctgcttagctcctacaggaaacacttcataagtgttgttttctgttagatatcctgcctgagaaatcacacccctactcttgcataagtgggaaattcttcaaatcttaggtgaggaatgttagatggcttctcttctctttcaaggcttgtgcatgcagatcttttggggatcttcttacaatgcagattctgattcaacagttttgaagtggggcctgggatttcaaaatgccaacaaacccccaagttatgtcaaggcttcaatcacactgtatagcaaggttgacactgtctttaaagaatgatgcaattactaataggacacataaatctctaattattacagaactgaatctatgatcactaaaaaaggaaccatgaaagaaaagacattatgtctgagttatcataccttggctaaggtagtaccaagataagctcttcacaaagctgaatgggcttcacaatgatcagggtggtagaattcagtgggcccacaaactcctttgcaacttatattacggatagggacatttcaaaatagacactcgaacagacagtgccgtgatctgtaagggttcaccaatatgtgcacacttaaaacttatacccattggctgggcccagcatttagattggcagcaagaccaacccctcctctccctccacctcctcagcctacttaacgtgaagataatgagaatgaagacctatatgatgatccacttccacttaattaatagtaaatatatttttctcttccttatgattttcttagtaacatcgtattttctctaacttactttattgcaagaatacagtatatattacatataacaatgcaaagtatacgctaatcactctttatgttatcagtatggcttctgtcaacagtagcctattagtagttacgttttgggggagtgaaaagttctacttagatttttcaatgtgttgggctcagcgcccctaaccctcacattgtttgagggtcaactgtataacactttccaaaggctccctttgccctgttcttagacacggcccagcatgaatttgtggcaatcttgtaatgagccacatactgtctaacaagttggatgctaattatacaaaacttttgaaaaaagggatcaaagttcctacttcacaagcttgaacagctgtagcctcaggaactttctccagattgagggcaaaaatcctatctccaggaagccaaatttgcagctgccacactctcccaaaatcccagttcacctcagggactgatggggagtcagtcatcatacttccttcccctttgggctgaaactgaaaaagcaaaaaacggggtgggagggtagaaagaacaggaagggaggtatcctgttcattggagaggtcctaaggaaacctggctggagtgaaaatctgctgtgccttaagcaccacccttccatccccaggccaatacacatcatattactctgttgtcctccttcaacagtgctagttacagactcaagtttaccattagtatataatagctataacacttgtccttaaaatgcgggttaactcaatgctgctgggcatcaatctaaatatattaaggtaggcactactgtactacaactctaataataataatcaataactatcatttattgaatggccacatggcaggtactatgcttatcagggcttccctgtctgctcagcccatgtttctttgtaaaacacaacatattaaaacaacagtatttggagacaaaaatatcttcaatccaaccacctcataataaaaccaacatattcagttttctatattatcttatcgtccttgtccatatacatattcaatggttatatatttgcagtaatatttatattccaccttttcactttttgtgaaacttgatacattatttgttcctctttcattctcctttgaaaatccaaggtaacaaatactgataacctagtatatatctctccattcctccttcatggttatgtaatcccataagattaattttatcttttttattttaaaaatggaatatgttaattgaaacttgttttgatttttgaaagatatcatcaccattctttcaggacagtagacacagctctaactagactaaataataattcattctgggatgcccaaataattccataacatattcaataatttccacactgaagggtatttgcttgatttctactttttgaccatcatagacaatgccaaaatacacatcctctacatacagcctttcatactggtacttttatttctgtagtattgattctcagaaatggagtgactgatcaaaaggtaagtgcatttaaaatttttgtagatcataccacatttctttcctcaaagaccacagcaatttgcgtttcatctgcaatatctgagagtgctctcttccattaaaaattatcattcttaatttctgtctatttgttagatagacatggtgtcttatttctttattttcctatcccttactactatgaggaagcatattatcatagttttatttttccagctatctggatatcctcttctgggaattgcatattcctatacttcggccagttttgtactgggttgtttgaattttaaaaaatattaatttaattaacaaatttgtaggagaaatttgtatattaggtatatgcatctctttatgtcacatgttgcgaatacatctactctatttgctgtttttcttttgactttgtcttctgttattttaagcagtaacaaggtatattttttccttatagcttttgagttttgtgtcttgtttagaaaacgtcttcctcattccaagaatttttgtttttacatttaaaactttaatgcatttgaaatgtattcttacattgcataagctaggaggcaatctgtgttttctaagaggaattgcaaagagtgctggcaccatttattgaataaaacacctttattccttgaattaaaataacacatttgccatataatgtttccaaaaacaatttgtatctatttatttatttatttatttattttttgagatggagtttcgctcttgttgcccaggctggagtacaatggtgcgatcttggctcactgcaacctccgcctcctgggttcaagcgattctcctgcctcagcctcccaagtagctgggactacaggcgcccaccaccacgcccagctaatttttgtatttttagtagagacggggtttcaccaagttggctaggctggtcttgaactcctcaggtaatccacccacctcagactcccaaagtgctgggattacaggcgtaagccaccatgcccggcctccaaaaacaatctgatctgcttctggactctcaattttgcttcagtgatctacttgtcttgttttgtgctaatactatactatttggattacagtagctttacagcaagtttaatattggataaggcaagccccctcccttattattgatgcagagacatttattatttttcatgcattcctgagatacttgcgattatttattatttcatatgaactttaaaagtctcccctcctcaatatatcttgccttcaaggcacttgaaatttacagggaatttaaattccaagatttaaataaaatcttgataagcctaaaatactataaatctattctatgaaacagacaccaatattaaggcaaaacaatgaaagtgaaaaccaataaaatgttcagagcactgcttaaatagattatgatacatccacaaaatggaacaatatgtagtcattaaactaacggttaagttctttgctatgggttgaattctgtccaaattttctccaaatttaaatgttgaagtcctaacccctggtacctcagaatgtgaccctatttggagatagggtcattacagagataatcaacttaaaatgaggtcatttggttgggcctgagtccaatatgactctgtccttaaaaggggaagttggagacagacacgtacacagggggcatgccatgtgaaaatgaaggcagacatctacaggacaaggagcaccaaagattgccaacaaaccatcagaaactaggggaatggaatggaacagattctccttccgagccctcagaaggaaccaaccctcctgacaccttgatctcagacttctatcctccagaactgtaagacaacagacttcttttggttaagtcatccagtttgtggtatttcactattgcagtcataggaaacaaatacattctttatgtactgatacaggaaaatgtccaagaaacattgttgagagagaagcataattcagaagaaaatgtgtatcgtatgctaccattaatgtaaagatgcatatatatagaaaacagacacacacatatacataacataaacttatgcatattcgcttgaaattcgtacatatctcctgaaggatatacaaacagctgacaatactgattggtggtgggtaggggaattgattcgacagtgcatagaggtaggagaaataatttttattttatacctttttgtaaattttcatttttgaatcatcaaaatgatcacctagtggaaaataagtaaaattaaaaacaatcaaataagaccccctaaattatcagctttctttttactatcttaattaaatcagataacttgaacagatcttcttttgtactttctgtgtggaaagttatatcagactgaaacatgttaatacaaagtatttgcatatagacatagacctctatctttcccatttactcagacaacaacttttacaatgttaacatgtgttcaacattgcttgaagtaatatgggagttaaaagaatacaagacatactttctgtattacagaagctcttaactgagtgatggagaaaagaaaaaaagacttaggtgaagcatgaaagtaagtcacttcagtttctttgtgcctgttttctcaacagtaaaataacaaatgagataaatgactgttgaagtcttaaaatttctgaattgttttatttgttttttgaaattacacttttagttttgagataattgtatgttcacatgtagttgtgagaaataatacagagaaaaccagtatacccctgaccccgtctccctgaaggtaaaaccttgcaaaaatatagtacaatatcataaccaggatattgacattgacacaatcaaggtaaagaacagttccaacactacaaggatgcctcctgtgttgcccttttggagtcacatccatctctctctctctctttcccctgttgtcccggactccttgcaatcaccaatctgttcttcattctttaattctgtcacttcaagacggctatataaacagaatcattcattatgtaaccttttcagatgagctgtttttactcagcataattctgtggagattgatctaaaagttgttgcatgtataaatatttcattccattttattgctgaatagtattgcctggtatgtatggatgtaccgtagtttgtacaaccattcattgttgaccgtctgggttctttccagtttttggctataatgaataatggtggtatgaatatttttgtacaggttgtaagataaatgtccaagagtgcaattgctgggttgtatggtagctgcatgtttagttttacagaaaattgataaacagtttgctacagtggctgtaccattttacatttccaccagcaatatgtgaatgatccattttctccacatccttgctagcatctggtgttgtaactactttgttttagccattctgatagatgtgtaggaatatataataattttaatttgcatttctctaatggctaatgtttttgataatcttttcatgcacctatttgctatctgtatatcctttttggtgaaacgtttcttgatgtgtcttgcccatttcctaattgcattgtttgtttcttgttttaccttgcagttttgagagttctttatatattctagacatccatcttttggctatatggcttgaaaatattttctatcagtctgtagcttgtcttttcatcctccctcacaggtcttttgcagtgcaaaggttttaaatcttgatgcagtccaactgatttttttctgtgtgtggatcatgctttcaatgccaattctagccctagagcctgaagattttctcatttttccctaaattttgatagttttatgttttacatttaagtccatgatctattttgaattaagtttttacaaggtgtgagatttaggttgaagttctttttttttcccactctagggatgtccaatttctgcaggaccatttgttgaaaaggtgagctttctctattgaattgcttttgcaactttatcaaaaatctgttgggcacatttgcatgggtctgtttttgggttctctattctgtttcatttggtctatgagtctatccctccagcaacatcatactgtattgatagccttactatattgttagccataatattgggtagagaggttactcccactttatttacctttttaaaagactgttttagttattctgtggcctgtgacttttcttatagattttagagtatgcttgtctatgtgtacagaaatccttgataagattttgatagaaactaaattaaacctttagattgatttgagaagaactgacatatttgctatgctgactcttccagtctataaacatgccatataatccacttatttaggttgtttttaatgcctttcatcagcattttataattttctacataccgatcctgtacatgtatgatagatttatacctacgtatttcatttttggataagcaattataaatggtgttgtgtttttaatttcacttttcacatcttcatttccaacatagataatccgtaagttgtgatggcttgccttatgattttttgactttatgatgggtttatctaaatgtaagcccatcataagatgaggagcatctgtatataaaaatgtgactagctttggtgtgttgatcttgtatttttggatcttgttaacctctcttctcagctccatgagcatttttggttatttttgcttttgtttttgtagaatatttgatattttctacgtacacagtcatgccatccacaaatagaaataattttattttatacttttcaatatgcatgctttattgtttttccttgctttattgtagtgtctggaacttccagaactatgttaaaaaagagtagtgaaattgggcatccttccctaattagcaatcatgggtggaaacattaagccttccattattaaaattatgctattaactgtagttttctgtagataccctttattaagatgtggaagttatcctctattcccagttttctcatagtttttatcatgaatggatgctgggtgttgtcagatgcttctgcatcaatcaatataatcatatgattttttcttctttagtttgttgatatggtagattacactaattaactttcaaatgttgagccagccttcaatactaaatcccagttagttatggtatgacactctttttttaaactttgacgcatgttatttaatattttgttgatggtttttgtctctaggctcatttatttattttagacctttcctgtcttctaactaaataatctaatgctatacattttattctcaatactgcttttatgacatctcactttatttttttttgccagagaaaaagactagattactcacagcaaagcagtagtcaaagaaccaacattttattgagccagttcccacagagtaatcccaaagaagttcaggagacacctgtacacacagtggattgcatcacaggagagaaaccctgagcttaaggaagcttaatctttaaaaatagacagtagatatgcttgccctttgcttcagaatctcactcatgttgatgttttattttcattttatttagttctttgtgtttaaaaaatttttctttgcaacctcctccttgacctggggaaaatgatttaaaggtgtgctgcttcatttccaagtgttttgaggtttttcttttgtctttctcttattgatttctagcttggtttcattatgttctgggaacatataagttgaattctctaaatttgctgaagttgcttggagtccagaatatggcttatatcagtgaatgtttcatgagagctttaaagtaatgtgtattctgctactgttgggaggagtgcttcaattagatcctattggttgatggtgttgttcagttctctttacccttgcttattttccatttagtagttctatcaactgaagagagaggagtgttgaagtccctaactagaaatatggatttgtctgtttcttttttcagctctattcatttttgcttcatgtatttggaagctctgttgttaggtgcaaacacatttaggattattatgtcttcccagtgaattaacacttaatctttatgtaatgtccctgtttgtcactagtaattttctttgcaatgaagcctactttatctgatattaacattactgctgctgctttcttttgattaattgttgcataatgtaactttttcgattcttttaattttaacctacctaggttgtatttgaaataaacttcttttagacggcatattgtgtgctcagcttttatcaatccactcagctaaatctcttttaattggtatatttagaccatttgcatttaaggtaattatggatatattagggcttcaatctgccaccttatttggtttctgtttgttttctttatttctcattcttctctttcttttttcttaccttcttgtgggttatttgaacatttcttaagattccatcaaaatttatttgttgtattttcttaacgtatcactttgtatagttttttagtggtctttccaggcattacgatacgcattaacattgcaatctactggaattgacttcaggtgacgtgtagaaggactcttacttccacttaggtatgtcttcttttaaaatataactcttaagtattttctctacatacattgagaaccacatcaggtggtgttaaagttttcacttcaaacttatggtaaataggatagtctattattttactctcatttttacccattctactattttctttctgaaatgtcaagacttcgttataatttcctttctgtttagagaatgtctttttgtcattctttaagagcagatttgctagcaagaaattctttgttttccttaatctgagaatgtctctttccctttaattccttaggaaaaccttaggagttatctgattatctaagagtctgtaccttagactttggttatgctattttgcaattctgtacgtttaaaagtcaatttgtggagggctgatggtgacacaaatgattcttgttcactagatgccagtaaaattttctcatggaacgcaatagattcctgccctacagttagtgatcagtattgtatctgttataaaattcctatcagcattctagagtgttttttatatatatatgtgtatatatataaaatatatatatacacatatatgtatatacgtatatatacgtatatacgtatatatatgtatatacgtatatatacgtatatatacgtatatatatatgccaattcttcagactctcctttgaaccaactgtaactaacatcttactaattccttcatcagttaatgatctaataaaatgttttacacatattcattttatatttttatgggactcacaattttgtctctttagaaatgtagccttatataaaatacagacataaaatgacccattaattcattattttacttacaaaaggtacctatgtatctgaaagttttctaagtgcctgacacacagcttcccctaatgataactcttctgtacgcatgagagatttatctaaacatttaaacaaacactgatacaacactattaacaaaactacagactttattcagatttcaccagtttttccactcatgtcatttttctgtttcaggatccaatccagaatctcctactgcatttggtccttgggtctttttggtctcctctagtctgtgacagtctctcagtttcttcttgttcttcatgaccttgaaacttttgaataggactagtcaggtatattctagaagtctcttaagatttgactgaagtattttccctattagaagaagttacaggttttggggaagaataccagagagataacatgtccttttcatgacatcatatcacaggagacatgatatcaatattattatcactggcgatgttatacttgactacttagttaacttggtgcctgcctggtttcttctccattgttattcctacttttccatattctattatctggaagtaagttaccaagttcatggaggggcttaggggaggattaaactctacatcccaggaaaggagtatctatgtatattattaagaattgttctataagggaaaattttctctcaaatatgcttttttactaaacagagaaaacacattattatctgagtggttgctatatggctaatctcatttaccttcttttgtcaattcataaactggtcttttttcccttttcgggccagtataacttaataggattgtttatcttatgttattaatttatttgtagatgacaaagattccttttggtaggttctggcactcaagactaataggtttttccatatatttctatggatacaaattgtaccagcatgctgggaaggaaaatgagctgacagtatatgtgtcactttgaatcactgggtatcctacagggaatatcgagttacttaagcttcaaagaaagatgtgacaatggttaaccataatttagatttggattttaatattctcacagcctggctggcccatcaattttttatgatgtttttctcttaagtttctcaacaatttctctgggcaagtttgtttcaaatgcaagactaattttaagcttgattaaaatgttaaacagactcatgccatttgtattatcctttatgaaaaaatcaatactttaatagactttcttaggaaactattttgagaaactcaatagcattgttaaataaagtagaatgtcccatcagattccagtattttatatgtattctctgacaaaagggtaaaataagaagcaatgagttacatgataaaagatttaaaggggtgtgtgtgtgtgtgtgtgtgtgtgtgtgtgtgtgtgtgtatagaaaacagcttttaaacattacagtattctgagctaagggtggaaattcacctcagagaatttttaattgtctgtctgagtcctgatgcctcaaatttagcatgttattaatcttctaacattaccatgttctattgcaatatttttaaaatattgtaatttttaaaaatctgtctccgctactagattgtgagctctgacttcaaagactatatcttatttctacttctttcctcggtatggaacatcacacctggtgtacagtcacactagctatatttcaattgctcagtagccatatgctacagtactgcacatcacggatataaaatatcttcatcatcgcagagaattcacatcacagtcctgatttagagcaggatgtctgaaacttggcactactgacatattggaccaaataattctttgttgtggggggctgtcttgtgcattacaacatgttgagcagcatccctggcctctgcccacttgatgacagcagtatccccgcccccaatgtgacaaccaagaatttcttgagatactgtcaaatgttctctggggatgaaattatatcaggttaagaactactgacttagataaatactccctgaactagagtcctggaaacctttaggtggccaagacttattctaaagaattgctaaaaattattttcttttaaaagagatgccgggaggagagagaggagcagaaaagataactactgagtagttggcttaatacctcggtggtgaaataaaatgtaaaacggacccctgtgacaccggtttgcctatgtaataaaccttcacatgtaccccacaaacctaaaataaaagttaaaaaaatgaaaagaataggaatagattaaaaaataaaaataaaagtgatttcacatataacaaatgtttcctatcattgcataaggcaatgctgcttaataaaagaaaaatttagtatagtagaatcgtgccgcagtcatgagaagcaacccttccccatttctcttaaccaacacaccttgaatccatcaaattaaattcttgcataagaggtaaccaccttcagatttctttcttagacctgtatctctaaaagaaaacatccttaccactttagtgcagactggcctggctttcaactatgaggatccacattttttttccctaatggctttagacatactctggacacaaaataatttttcttgccaaggtggtatgccagaaatgctaggaaaataattcccccgttggaagcagtcctaaaccaatgactagcaggattttgtgtataaataccccagctcccttgcccctttgaaagaataactaactcttaaacacatgtcttcaatccatttagaatttccccagtgggattaaactccactagaccagtggcagttggcttgataatgcattttttactgaatgatttctcttcacagtctcactatcttacctcacattcatctctgccttctgcagtagctggtgcttcacatttctaggacttcccaagttctaagtacttggaattcaggtttccaagatatgctaactcctccattctctgcatattcctaaattttttatcttttttattttattgtttttcctcccagatttttttctctttgtggtaaatatcattttaattcccctattctcattttagtgaaggttaaagagacatcatttttaaccagaactccctataagtgatctatggaaagaaaaaattagcaagaaaaagacatttgactagttgcatgagtcaagggttaagtaaaggagaggatgaaatttgtgataatttaaatttagctagtgggaggttgcaaacaaagactcctctctctgtaagctagaattctttatagccttaaatttcccaggtctagtttagtatttatatttattttcctcactacttttttactgcaaaatattcggaaaccatttgtaactttaagtcacacaattctaatttaatgattaggttaaagcaacaaaatttcctactaattttgtagctctataacactcagatattggcaatcctatatggctcaaactaatactttaacatattgtttatggacatactagaaattgtactgtgtatgctaacttctacactgggatctagattttgtacctctggatcttttctaagctgaataaatatgttcatacaaggttgtactctggttaacattctgtttatcaaaagacatgataatcatgtatatgaaacatgagaaaatttgaatcagttaaactgaaagatctacttagaaaaacatctacttcttctccgagtcacattcttgtgaattctggctttttaaaattatttttgaaattttagtaagattacataaaacagcgccatgtaaactataaaggatcatatacaaatgaagcacattactattagtaattataatgcaccaccagaaataagagatagaaggccctttaacctattttgactatgagacaggaggatagaaccaattcccccaacagccagggttcagtattattaataatgataataaaatgaatctactaacaacataccaagccttcacaatatgcagggcaccgtactaagtgctttatataagttttctcatttaatcttcacaatattaatctctactcctattcctctatttagaaaccagacctggagtgattgagaaacttgaaggaaaatcacacagtttgaaagtgacatagctagtgttcagaaacagagtctacactttcattactatcctccactgcaggataattccagtgcaaaggatgatctgtttgtttttttttttgtttttttttttttttgaggcagagtctggctctgttgcccgggctggagtgcagtgactcgatctcggctcaccgcaagctccacctcccggattcatgccatcctcctgcctcagcctcctgagtagctgggaccacaggcgcccaccacaacacccggctgattttttgtattttcagtagagatggggtttcaccatgttagccaggatggtctcgatctcctgacctcgtgatccgcctgcctcggcctcccaaagtgctgggattacaggtgtgagccactgtgcccggctgcaaaggattatctttaagttaaacatagaaataaggatgtaaaatggaatttagaattctgaagtctatcaacaaggaaactagtgctatgaaaagctaggtaatttgtccacaaatacccagtgctacctgcggacagagctagaaaagtgcccatatggtcatttacttcaccaccaaagtgaaatgcaccaaaccaaggggaaatgacttctctgggagtttaacaactctacttttttttccctcatttaattataacatggtctgttaacttgcaaccctctatttgatgtctcttcttttttcagtctttagcaaattccacatcgtatttggccaaatcagacataaaattaacatcaattcattctcaagagacaaaataaaactacgattttctaatcgtagttacttttctcctaatcttttgcaaatgtcaccttctctatgaaaatgctatgttcaaatgacctgtgtaatatttcatggctctaatgcaatcacaaaatatatattcggtatcaagatatataagatacatgttaataagtccctctaaagttgtcaaatttacactatcagaatgaaagattcctgagggctaaataaattttgtctctacctttcctcctcttttacaatgcctggtcttgttgtataaacacggtgtttcagtatcttcttgatgataatgaggtggatttggccaatctagctatttaaaaagtctgctctgttcttttaacttagttttgtagatgtataacaaaactagttatggaaattctctgagatttagataaatcattttttcacataaaattggtgctacagaaataatatgtggactataagctttcactattattgaacatttggccatatctatgaactattgagacagttgaaaaaaaagccacagctggaactatatcgagctcaactctgcaacttaattgtgaaataaatacaataataataattgtaacagcaggacctaaatcatgctggtgtaactgctgggtttgtcctcagatattaactctaaaggttatattcattgtggtgccacctgtttggaaagaagggcacatcaggattttgagtacatattttagagttttcctttggtactgtaccatataatatggaacactaaaatcacaataaaatgtgtctgctttgtgtgaaggtaagtaagtgccaagcttattgtaaggcatttcaaatcttggacacaacgccttttatatttcaactaatatactgggctgttgggctgtgctcatttttataattacagtagtttcctacataaacagttttaaatggacccactgcaacatgccaagaaataattagctcctatcatttaatcttatatatttatatgtatcatagcatatgttggcacataacattcacttactaattcaagcatcatcaagtaagtctagatcagaaatatatttagcagttccacctctacatactctttcagactgagctaattagccactagttacagagaaaaagataatactttctaaaatatatatttagatattttctaaaataactttactttgaaatggtttaagaccacaaaacttgcaaatatagtacagagacttctcacgcaccttttacccagcttctcccaatgatagcattttaaatacccatagtacattatcatcaaagctaggaaactgacattggcacaatactattaactcaaatacagacctcatttatatttcaccagttcttacatacatccttctaaataaatatttattttaatctggcttaaatcctaagtcttatggtaggcaagtatgttttatagcggttttaatatcattcaaaattttctaaataatgttcagtgtagtaaaattataagaatgatattctgatcacttaattcaaaactctttgctttctgctatgggactgttgccacagaaaatttcaaaaattacttttttttttttttaaagacagaaagcatcttgaatgagagggcctgactttgtatccctgttaatatgtacgttctcaattactccatagaaaccatatatgaaaagtttagttctgcttctttgctcccaagtctcatttcttactagcatttttcttaacatctggttcaatgttcacagcagatcagctttcaaatacttttttttaaaacccagaaattagtcaattttacatttacaattataggtcctttaggatattctaacaagtaaaaatcctaaaggcaaaatgtatgttttcaagtaaaaatatatgaggttgtttttttttgacagagtctcactctgtcacccaggctggagtgcagtggtgcaatcttggctcactgcaagctctgcctcctgagtagtgggactacaggcgcccaccaccacgcccggctaattttttgtgtttttagtagagacagggtttcaccgtgttagccaggatggtgtcgatctcctgacctcgtgatccgcccgcctcggcctcccaaagtgctgggattacaggcgtgagccaccgcgcccggccgatgagttattatatatagtgcttcatattatccatcactgttcctatgctagaagtcactcacaaaagctaaagagttggcatagctatttagcaaatataaacaaatatctgcttcctaaatattttaaagggttagtcattattaatttttacaaaatgtattgcaatcacattaatcgcaaccatataatatctttgtaatgtggatataagttattcaataggcattcgttgtgatattactttaattaatacttgttttttgtaaagtattacccgccttttgatggcatgtccttaatgactacccctcttttggtgagtgccagatcactattaattccttttgtattcattataacaacatcaatcagggaaagctcatttgctattaatgtgaatataacaggtaattccattctaatctagtagtgattaatgttcacttggtagtaattacaatatcacatttcagagtgttagcactggacaatacttattttgtgtggccttttaaagaaccacagcagcttgtctggacttagaattgaaaaggttaaagaaaggcaattaatctaaggacaaagagaaaggattcttatgtggctgggaaaggtgaataatggttaagtgaagggtttacaaaatttgttactattttttggtcaatcagtatgcttcatatgtacccagtaatatcactacttgacttgtaaaacaaagaaaactgaaatcgacatgtttaaaaagccactgttttagctccatgatgccaatgaattttcaaactacatggattccctgtcctaaatgacagattactatcaatgtgagagttacaacttatctttaaaagaaggggcccttttgatgttatcattttatttgtaaattagtaaaaattaaatgttctacctaattttgaaccaaaattgcctttatattgaaaaaaatcacctaaaacacatcgatgatatatattaatattatagctttattctattttaggtaaactatacaaacttccattaacatcaaccagagagactcccacacatattgacacaatatgttatgttagatcagagcagtgctagtcattgagttttaaaatcctggaaatattaaacttactggagaacattataggttatctgtaggcatcagagatttataggctatatggggtggaaaatgcatgtgaacctcaaaacaaccttgaagtataggcaagacaggtgtcattaatcttatttcacagatgcggagattgatgctgagagaagttaagagacttgccctaaatcccactacagagcatttactggaacccagggcttttaacttattttcttggtctttccactgcagcccatgccatcctgcctccactcacttgtgacagcctgtagagaacagatgtaagaaaaattgccaagagtttaggagtatccaaataacaaaaactatcagactattagggtggccaggggagaaagagaagagaggaaatcaggaaggctgggatttttcaaaccatttgggcacaccccaggtttattcctgacatattgaataccaagtctgtaagtcacagaattcaaattacaaagaccatcagaaagcaagatttttgatgcgctaccagagccacttagactaattcagaaactaagatgaggctggcctataaatgaagcttattggtagatacaactggtactccagggcagcaaagggaagataaataaatctgtgcaatgcgtcaccttggaaaagtcaattgctatttatttaacttcatttcaaccaacaattattattaacaacaaccacgtatcttgttgaaaattatgaatagaatgattaacaggacaaaatcattgccttcaataagttcacagctgataaaggctctaaaacagggctttccaatgggtatgctaaggcacatgccctgattgggttataggtacttcagatatcgatccctctcagccctgggatggttaggcagcttagagtcttcggccagcttacctgatatcatgatgaacacatcaacttaatctgttcatcatgatatcaaaaagactgaggaacactgcagagaagtttgggctttcttacagaacagactgactgtatagcttagctgagggagatctggagaccagaagatgtttccaagaagtgtgataaatctcagcttaagccagaagacaggtgagagtctttgtgaacatttcagccagtttaatgagcaatccaacaacattaagacatgtcaagattagcaagcttcagattgtgtgataaaagtgcaaagagttcgctagagccatactgaataatttgtctttctcttctacctttgtctgccaacaattctacccattggccaaatgcttctttctctaataaattcttgttcttgcacaatcacttgctcctttgaaccacctaaatcgctgtttcccaaaatgtggtttgctgaacagtagtggtagggagccaatttaccatgttacacagataaacagcttatagtttaaattttaatattcatttagttttatctgtattaaggaaaaaaacactgcaacatcagactacagttttgtgggaattatcacttaaggctaaaagcagaaaacaaaatgagctgattttaagaaaaacattaagtaaataatagtatatgtgttattcaaaagattgaacaatggagcgtatatttgtttcctattgcttctgtgacaattttccataaacttactggcctaaaacaacacaaattgattatcttatagttttggaagtcagaagtttgaaatgggtttcatggattaaaatgaaagtgttggcagggctatactccttctgaagaagcttagaggacaatctatttccctgccttttccagcattagatgctaccaacattgtttggctaatggcccctttctctatcttcaaagccagcaggggctatcttcatctctctgactcccactctcctgcttccattttcacttatatgaaccctgtggttagattaggcccatctgaatagtccataaaatctccccatctcaaagtcacctgcttagcaaccttaattccgtctggaatattaattccctactgccagggagcacagcatattcacaggttctggggattaacatcttcgaggggcccatgattctgcctaccacagggggaaataaaacttgctttagccaatcggatattgcaggcttaatggaagcaggggctcaacaaattgtttacatgtttgcacttccactcttcacctcagccttcacaaaaaggacttgctcgggctggttagcctgctggagggatgttcaagatgtgagcgatagagctgtgttgacccagccactttcagacacttaagctctcagctaccctccagattcccaagggagcccagtcagagcagataaactacccaatgtaaaccatcagcccacaaattagtgaactcaagaagtacctactgttttaagctactgagttttgaggcggtttggtaatggactgatatactattatatataactgatacagacataaaatgatacttttgccaggtaaactattaaaacaaaacaagatttaccatccactgttaccatcatattgttaaggaaggggtatttcaaccacaagaaataatcagaaagacatagtctcagcctaaatggtaggctgtcctaagaaaggaggatgacaagctacaagcttaaataatttctctttctctctctctctctttctgtccttatagttctcatttctctgcttattgaggaaatcttcttcacagatcatctgcatttgagaacctctgccacacacgacttaatgtaatgctttgcacattgtaaaccctcaagaatgttgttaaatgagtaatcacaatgtgaattaagtcattcacaatggaatgctgctaattctggaactgagtaatgtggtcattgcagtatactaagctgcgtgaaaacttctagaaaaaaattatagagaaaagttgccttctcctttattttagcaatactattgcagcatataaaatcaagctgggactttatgggaagctgcgccttgctaatttaaaaggacacactgactacatgctgattggcttggggggaaggattgcttaccatgttgttttgtttctattttaattttcacctgcctgtctgcgaattttccttaccatggtaatggatttaaattaatcaataaggtgttatgaagatttaatgtcaaatacactttaaaaacctagtttgaaaacttccaggtctatttagcacatgtcgtagtgtggcttaacccatggtgcattaacaaaataaaggtcaaagttaaattttagaaaaaggggaacaatattcctcacaagacattccagtgggataaaaaacacaggtttttttctatattgacaaacctagattcttaattataataactcttcctaatggtctatatctaatcaggtacagtggaatattaataaacatgttttatattctctggttatattgttaatggatacttcaatgcactgaattagaaggcactacagtgcatattgttttatcaagggcaagtttattttgcttcatctatgtaaaaacacattattttttgaaaagataacttattatttaagggtaagagtattagaatattaaaaattgatcacagaaagagggatggatagatgaatatgtaataaatcaagtatagtaaaatttcaatggcaaagtataggtgctgggtatacagatgttgaccgtaaatttctttcgactttgctgtatgattagccattttaatattaaaacatcgacaacaataatcctaaattgtaagcactgtatctttacatacttgtataccagtgccaccattttgtagctaattccttttctgtaaatgtgattattaaacctttaacactgaaatatctggcacatgtatacatatgtaactaacctgcacattgtgcacatgtaccctaaaacttaaagtataataataataaaataaaataaaaattgaaatatctgaaacaaagttttagggggcgtgttcatcctgtacaacttactgagagatttgtaatgccctatggaccagaggtctagtctgaagtttgaggttatttttaaagaaagaataagaattcgttgaggatgggaagttgggtagaaggtctttgcggcagatggaagtattgggacgtaaggtggataatatccaggcagccttaaattttctgccacatatatcactcaaggagagtggaagaaatggggccttggagagattatgtcatgtgtgaccttgcatgctacaccaaggaggtgggaatttatcttaaaggtattgaagaatttcaaacatgagtatgggggtgacggcatcagccttcatgtcagaagataactctggctgaggaagtgatgctagatgcagaaagaccagtgaacaagttaccggagttttctaggatacgaatagtaatagcatcatcatcagcagttatagtgactattctttattaattgcattttatgtaccttactctctgtatggtaatctcatttaagccctttagtcaccctaagaaacagaaaactttatgaggaaactgaggctagaagagatttaaaaatttgccaacggtgacaagattcgaatcaggtatgcttgacttcacagtgataagggcctgaaaccatagagaatcatagagaaaaatctgctttaagacagacttaggaggtaaaatttgcagtcttttgtgtcagtgtagacatatgcataaaagagagaagtctcaccagaatcagaagtttctagcttaaataattgggtagatggtggtgccatcttctgaaatagagaatagaggcagtaggggatttcagtttgggacatgctaatgttaaaatgtctgtggccatgagtaagactcaaaatatttgacaactgctttagcaaaagcccaaccaaatagagaaaacactactcagtacaccctacctgtgcttatcagcaggtaccagtcctgtggtctaaatatagaagttcactggggagttgcagatgtcaatgtagaatggccaagaggggtacataggcagcatatgctttgagagtcatctgcttatagatactaattagagccgtggatgaagatgagatcacagaagagatgtggcatggaaagtgaagaagtgctgagggtaggatctggggagcagccatacttattatggaagaggctgaggatgaatcatcaggaaagagactcaaatgtcctatggagacaggtcaggtgaaaacctggggaagagggtgttagagaactaaaggagaaaattacaaggagaagctgagtcaggcaatttggcagggggtaggctattgattttcttagtgagagcagtttgcctggcacggtaggagtaatagccagataaatggactgaaaagtgagctgtgggtaaagaaggtgagctaggcagctctgctacattttcttttctttttttaaagttctatgattaatttttattttaagttccgtggtacatgtgcaggatgtgcaggtttgttacataggtaaacatgtgccatggtggtttgctgcacctattaacccatcacctagagatatatatatatatattttattattatactttaagttttagggtccatatgcacaacgtgaaggttagttacatatgtatacatgtgccatgttggtgtgctgcacccagtaactcgtcagttaacattaggtgtatctccaaatgctatccctcccccctcccccgaccccacaacaggccctggtgtgtgatgttccccttcctgtgtccatgtgttctcattgttcaattcccacctgtgagtgagaacatgtggtgtttggttttttgtccttgccatagtttgctgagaatgatggtttccagcttcatccatgtccctacaaaggacatgaactcatccttttttatggctgcatagtattccatggtgtatatgtgccacattttctcaatccagtctatcattgttggacatttgggttggttccaagtctttgctattgcccatcacctagatattaagcccagcatgcattagctatttttcccaatgctctccctcccctcgccccaccccccgacaggcctcagtgtgtgttgttcccctccatgagtccatgtgttctcattgttcagctcccacttttaagtgagaacatgtgatatttgcttttctgttcctgtgttagtttgctgaggataatggcttccagctcctcaaagatctagaaccagaaataccatttgacccagcaatcccattattggttatatacccaaaggaatataaaccattctattttaaagatacatgcacacgtatgttcactgcagcactattcacaatagcaaagacatggaatcaacccaaatgcccatcagtgatagactggataaagaaaatgtggtacatatacactgtggaatactctgcagccataaaaaggaatgagatcatgtcctttgcaggaacacatatggagctgtgctacagtttcacaaagtttggccatcagaagagggagagaattgacactaggtacaggtggaggggtgaaggagcagcaccggtaagcttggacaattgtttgtttgttaaaatgaagggtaccagagtggtaagctgacagcaaaggatcagtaggaaggtgacttaaaaagtatagaaggaggagattcttgacagaacaaggctcagaggagacggaatttagaacagggtgttagcctcatactcttgcaccttccatatcctatagtcacacaatagccagaataagttttttttttaaaggaaaataagtcacaaatttattggctattttcccaactagaatgcaaactccaatgaggcgcggtggctcacacctgtaatcccagcactttgggaggctgaggtgggcagatcacttgagcctaggagattgagaccagcctaggcaactggtgaaaccccatctctgcaaaaaaatacaaaaaattagctggacatggtggcacttgcctgtagtctctgctacttgggaggctgaggttggggggatcacccgagcccaggaggtggaggttgcagtgagctgtgatcataccattgcactccagcctaggcaacagagtgagaccctgtctcaaaaaaaaaaaaaaaaaaaaaaagaatgtaaacatataaactccagagggtgggaccactgttagctgcgagggacccgacttgccgaaccagtctaagatatttctagttactccttttctcttttttcgccctgtgaacaatttaatatttggcttcttccttttttttttttttttaaatttcttcctccctactcattcccactcccaaaccaaccacaaagctaacctcagctttttttccaaattatcccttttgcttgctatgaacacaagtttgaacctcagctctgttggtgataattttgcccataagaagcttctggcaaaaataaaacaaaataagtctttaggcctcattctttaggaggttttgctggcctaaattgtttttgctttttaatggtattttaattagtgtttcaccaagtgtggttctcaatcagcaacaatagtatcccctgggaatttgatagaaatgcaaattatcaggcccctctcataactaaatgattacactttgtggagtctcttcatctaaatgtcttcagtggcaaaagccaatgaagaaaatctctgtatatagttttttttttggtttgtttgtttttgtttgtttgttttttaatggttctcagggtttggtctctagaccaatgccatcaaaatcaactggaaatttgtgagcaatgtgaattctcaggtcctaccctatctgtaactgaatgtaaaactctaggcatgggaccattcaatctgtatttctacaagtcctctagtagctttgatgcatgttcaagtcggccctaaagtgttggatttataacctataactgtttctttctagaaaacaactatgtcgggggaaaaataaaaagaaagttttctattaattaaaaacgtagaattcaagagctaaaggaatctcaggacaatgattagcaaagataaatatacaaaggaatataaagtaaaaatgcaactgaaaatggctgaagagaacgtggactaacacataatgtttgaaacagagtatactatttaaaagctacatatgtgctaaatctcagaattcttctttccatgtgctagtttgagaggcaatttatttctggcacaactgccatatgcatttatactaatgtgaaagacttcttgtaatgagaaggtaatacactgcatttagtaaactagttttcaatgtgagaaaaatgcctacatgaaaatgttgccctttaaaaagcttcccttgactattcctgtttatattcttgatagcagaatagctttgggaaatgttctgaatagaatccaaagctactctaaagataggctgacaaggttgtcaccatacagttcctatgtaccatgaatcttagaatcaagaacgtttgaatcaagacatttctcagagccaatctgagatatgtgtatatttatatgtatctatttgagacaactctcagggaacaagacatcaaaaacaaattgatcaaaaggttatacgctcaaatgaatgttgcattttaacgcagtgagtaatggtacaatttaggaactaaactctttttgaaactgcctttcaagacagtttgcaattacaaaagaaatgttcatgggtatctactttttttatttgaaaaattgattgcatctaggtttaccattcatgcattttgttcaacataaaaatattttagactgacaaaaaataaattctactttcaaaatataaaaatttgatacctttaaagatgttaaaaaagaaaaagacacagaatagtaacaacaacgtaggaataattgtataggctcctaaggtgaccattaagaattctaacttacaggtattaagttttttatttaaaaaaatcagttgttcgaaggaaacacaatttcaattagacaggaggagtatgttcaagagacctattgtacaacatggatactatagttaacagcaatgtattatatacttgatacttgctaagagtatactctaagtgttctcaccacaaataaagtgtatgtgaggtaatgcatacgataattggcttgatttagccattccacaatgtatgggtatatcaaaacatcatgttgtacaccatgaatatatacaacctttatcaatttaaacaagataattaaaaatcagttgtattacttaagttgcttgttaaaatatgtatctgttactgtaatcaatacaaataattatgaagcagttcatgcatgctggcaaagccagtcaagccattcgtaagtgcctctcgttggcagtgaatgtattttttttccttggcctcctaaggcccttatgactttttctgggtcagctttgttaactcctctcacttagctccattctcaatggtcagcgaggcttgggattagtcattttcacttttcttggtacatggacctctctccccccgtactctcagtatttcaattatcatttgactgtagataagctcccaaatctttatttcagcttaatattctatcctgaatttcagactcacacagccaactgcccaagaatattccctgaacttgtccgccttttggatattccctaaacaggacacgtcctaaatcagtgttctcaaagcctggtccctcaccagcggcatcaaaatcatggaagaactttgtagaaatgcaaattatctgtgccctccccagacctccccaattagaagcttaagggtaaaacggtcatctgcatattaacaagttttccaggagattccagtggagctaaagtttgagaaccactgtcctatatcatgcccagcgtttactctgtgtatttataatgtttttaaaaaatttccatattttatggatgcttgaacatcttgaggtccttggaaggccagggagagactgcccctcccagggctagctaattcctaaagatagcaaataacttgtaaacttgctcccttgtggatttgttggattgcttttcgttatacaaaccaactaatccaaagtccgtatccccaactaccttcttcatctaactgttgttacaccaaaccaatatttcccccaccctaactttttcccctcaccctagggcttggtaccagacaaccagagaccacttttacagccaggaaattttggaaattatttgaactatccagtcctaaacttgctcagacttgcctattctacctcactcatttcttttccttggaaaccacaataaagggtttgggctgtgctttccttttctgcctgctgaccgactctggaacttttttcctgcatggctttgcatggcgtagtatgtactcttcccttgagaactgtgagtaatcaaacttcttttaatggaattgatctctctatattgtcattcagtcatttctgtaaagcaaatccctgtgcaactaaaataccctgcccctcccaacataatctaagtcttgggttccctacttcggtgaaggtttctagctgtccaaaaagtagaaactttactttttccttttgtatattaatccattactagatagcaaagtctatgtttttttttttttttttcaacttggaatctattaacctctttcccccacttataccaatactccagtttaagccaccagtgtgttcaactgggcttcaataacttaacgaaggatatttttgcctcagtttatgcccttcatttcaatccaatttacctttttaaatgaagtcactcctctgcttaacacagaacctttagtggtttttaccattgtcatgcaagtaaaaaaaaaaaaaatctgacccttactaactttctagcttcatctctcccaattcaaactctaggtttaccaagcagcaatcctctcaaaatcactttcccatgacttcagacttgtgcacagtatgttgcctggcttagagaatactcctcatgtttccttccccctacctgaccaacccatctcttaggtctccatttagatgtcaggaggagcctttcttcatgccttcaggctcagctattctatcattccgggttctatcctatcccatttcctgctatctccctgacttattgggggtcctatttctgtcaaaatcagcaaaggaaagcgggtaggggttaggggaagaaggaactgggggtgagaaggaagacaatatgcatcaggataaaggaatgagctgttggcattcttagttgaaactctgaaggcattttccatgagtgtaaacgctataatcactttcacagatcaccttcaaaaatactgccatgtttgacctcttatttagttgacattgttatctagattgacatttattgacccattttgttttacttagtctcaatgtaagcaatgatatcttaaaatcaactgtttatagtaccggctatatttgcctaaaacacattaaatagattaaattaaattcacataattagaattttatgagagtgagaaattacttaatgggtacaatgcatcttattaaggtgatggataccctaaaaggcctgacgtgaccattacacaatctatgcatgtaacaaaattatacttgtacctcataaatttatataaataaaacaaataaactcaatgcctcccaaaataaatacataattgtcagagtttgtaaaagtatcaagccatgtgccatgtaataatattccattttcattcttccagtgggaagtaaacaataagggaaaaattatagatgacagataatgtatataggtatgtcataaattgaattagcctaggaaattaattataatttatatttctccctgtggcaaatgtatttcaaataccacacatcttaattgtaaactaagtaaaaaaaaaagactacttataatctagaaggcccttgataattgaaatacacttagcaatgaacaatcgagtttattttgctgattcacaattcacaagtaatcttaaggtcaggtttctgattgctcattcgtagttgttttccaaagtgttgataatctaattttgtttgtgctccaaatgattcttccaatgcaaaaaggtcccagctgctttgcaaaggtaggtaggtttgcctaaaaatcaagaacgacatcacccacaagacattttcttgttaagttgcgaagtaacttttagtatattttcagactagtgttttcctagactagtgtaccccatgcatgatctgaatcagacttgctcttaatcttccattaaaaacaagactttcattctagatatgaattttagtctgatatcttattcttaaagactactttcttatcacaaagttctcacatcaccaatatccaaaccaagacatttaagacaacattctcaggggtgataaatgactacagtttttgcgcttttaaaataggcttgggaaatgacctgtattttgcattacgtgcatcataaacttctaattgctcttacagagtgttctgtaaaaaagaatatccaccattctttaaaaatactatggcattaagactgaagccctgagagatgttaagatagactatttaaactctgtagactacatttgggaatgcttccaaggttagcagtgaagagtgactcatcagtgaagggccggaagttcttttccttttggtttaatgtggatctctcaaactactttctaatatggtaaccactagacacatatggctactgagcacttgaaatgtggctgatctgaactgagttgcgctgtaagagtaaaacttaccagattttaaatacttaacggaaaaaatctaattaataacttttgtaacaattacatgttaaaatgacaatgttttgggtatattgggttatatacaacatactgttgaaattaatttcacttctttatttttattttttcagtgtgcctactagagaaatttaaattacatatgtggctcacattttatttctactgggcagagctgctgtagtaaaatgaagagaacaagaatagccccacagatatcttagttttcattgttacaagccaacaatttattagacaattttctctgacttgaaatgacacaaaaatctcagagagatcctgtggtgtgagcgtttggagtcagaggcctatttttcatggaccattgttctggtttagtttaacaaatctactatagtgtaatatagtataaactatttttgcatttttgttcatttagaagtttatgaaagtcagcaagatgagcatttttgtgattgatgtatgatgcaataaattgcattgccaatttagaaatgtaataatctgaatttttgatcatcaagtttatgcataatgtatttttgagagaaaataaacacaagcaaagaatcaatagcatttccccagcccccaatcctcgggggagattctctctcattatatttaatttcctctttgaattaactcattttaaaagacagtaaaataggctcaaatgttttaattgtatttctgatttttttctgaagttaagagcaaagtagactgagtgaattgacagatggtaatgattttgcacaccatttatttcaggactaacggcaagttctattaaagtagttcctcctaaggagtttatctcaaccagtgaatttccattcagcctttaacacttgactcaaatgccacctcctcctctaaaaagccttgcctggtcctattgggcagttatccactgcatattctcctagagcattatgccttatatatatttctcttattgaatttctcctcgctgtcccaaactagagtgtgtgcttcctgacaacatggctgaagtcaacctgagtcttactaatctctgtattatcaatgactagtccagtgcccaacatataatagacatccaaaatgtgcatatattccaggtttctcaatgagatggtattaatattgccaaatattaggtatagtgtacttaacagtatgtctagttaaaacatacatatattctacatatatgtagtttaaatttctctagtaggcacagtaaaaaaaaagtaaaaataaatgtatacatatattctacatatatattctatatatatatatatatatatatggcacatagaaatattttaatgaggaatttgatgatggccaattttcaatgatttaataaccaagtcaatttttaattagagacaatttataagtaaaaattgaccttgaaaagtgtctcacacacacacacacacaaagacataatggaataataaaagaccttctagtcaccaaattaaatatttgtcttctaaatgcaatcacttcgattacgtttgctgaaaggattacccaaggctctttttttgctacaattatttaattatactcatggttttgactcatttgtaaatgcccatctgaggttttattaatcctgctcattactatatgttgacccagtctattgtgatctcatctctaaggttttatgagcacagcctgatattcatgaaattttccaggggtttgtaaaaatttctgggtgatcatattattaaaggtagttatgtctattctcgaaaataaacatatcttttcattacaatgccaaatacatgatcgtgggagggatcaaagaagtgtgtacatgatttagctgctcaactggtttaattactcaacacttttagctatgaagagagtttagaccattataatagtcctagattttttattcttataatttatatccatatttagagcattggttactcatgttgaaatatataaagggttgaagaagttataagggatcatatttctccagattttactccagatgatcttcagagtaagtcaatttgtaaaccgcatatagaaaatctaaaagtggaaatttttattgcctccgtattacagaggagaaaatggtggcacacagtttaagtaatttgccagggtcataaaggtagctggtaaagacttggagggggtttaaacccaagctctgtagctatagaatcttccaactggatactagacaaaacaaaagttcccagagcttcgctgcacattagattgagctgagtagtttgtaagaattatgatgcccaagtcccacagaacaccaataaaataaaactctcaggaaatcttgtgaaaaccaaagtttcaaaagaatgaaactttactcaattgatgctcaaagtgtattttgttaagatgtacttgaaaatgtcatttgagcctctcttatctgattgtttacagagcaaaaagaaaaaaaatagctaacttctgataaaacccaaaaactatgaagaattccccatgcctcgtcataaaagtagctttttcctcgactttatagattttatttgattttaaattttagtccacattttcatgtgtatttggccctcaaaccaagcatgtaatttaaaaaattgttaactcatactttttcttatgtaattagagttaaaaatcattgttaaagtgaaaaaaataaaacgtttgtctatataatgaatattattgtaaagcatattaaatgttaaataaaatcctaattaatatactaatataagctcttataaagttcaaataattaaacaatatttatattatcaacatttcataagataaaacacactaaataattaaaagctcttccaccatgcaaaaatgactaaacgattttttaatttctaaagctttttgagattactgtgaaaggggacatagtttcaggaaaggtgagtaaacactatattagactagcatttctcaatttttatactactgacattttggcctaaataattccttgtggagggctatcctatgcattgtaggatattttataccatatctggcctctacccactagacttcagttgtatctccaatccagtaataataattaaaaatgcctccagatattgctaaatgtccacttggtggaggtaaaaatatcccccgccccccattttgagaaccattgcaatagacaaattagctcagagttatgtcatctctaaacaacttagcataaacaaactagagaagccctttcgacttctggtctgaagaattctgcgtgtctataatacaagtttaattgatatgtacctaagttattatcagctgatataacaatttgtgatgctttctgaatcatcaaaaaaatgttgtttgaatgcttaagatgcttaatgtgttttgtaatacagtatactaaaaaccttggaaatcattaattaactgaagccatataattttgatagtttggttactgggcactttaatctaatctgtaaatcttccaatagatttccaaactcagaattttcatcctgctctgattggttaatctttggtgggatttaccatttatccattgcattataattatttgctgtgccttatcatataaagacaaaattgggtgtggagtagttgcccatactttccagggcatatcattgagacccacactcagtaggttattatgttctttaatggtttacacattgaagggaagtttcacctttcctgaaactataccccctttcacagtaatctcaaaaagccttagaaattaacaatttatttagtcatttttgcacggtggaagagtttttaattatttaatgtgtttatcgtattataaaacattgatcatataaatattgtttaattatttgtactttataatagcttacattagtatattaggatttttataacatttaatatgctttatagtagtatttgttatgtagacaaatgattcaaatatttgcctcattgttaaaagctcacttaaatgttttgacataagctcacataatttgaaaatattaagaatttgaagctatagaatttgaaaacattaatgcattgaattccatatggaagaaagtctgtttagttgagggacttcaatatgcttccattttccacttctgaagatctgtttcggctcatggtaaatattacatctttaccctcgctccccaaatgcttcagatggattaagcaccattctttttgtgtgggggagctggagagagaaatagatgaatatcttccacacccttgattccatcctaacaagtaccaataaatagcaacttctcacctcctctatagaggttgtcttcaattaaaaatacactagagagattataaccatagaaaggacattgagtagtgctttcggctaattggcagtacattccttccaaaatttcagaggtacctcaatttaatgactcccctgaataaagtaattggttgaaatttactttgcagttcttaatataactttgggcccatcattagcaagaactctaaaaaggaaaaacaaaaacaaaactggggtcagtatatatttaaatgaagcacaaggaaaaaaggtatttcactttcaaaggacctatgctgttttttttttttgaagattgcaactcatctattttataatataatgacaataatattgcctctgagttaactgtgtaataattcactttgggtactgcaataattgagcaaacagaagctggtaccagaggcattcctttcttttatttagtgtaatattttttcataatttaatgagaaacatttcaaaagcaacgtttttatcctttcatgttaaattaatttacaatgctataagctataataaaatgagagaaaccatcagcaaaaagcaaaagttaataaagacagatattcttaaagtttcaaggactgaaaaaagctcaaatcacaaaagtatttggtttctcctttttttgtggcttggttcaatttgtcataatttgttctcaattattttgtacttacagctagcataacataatattgatgaaggagaaaagatgcattactgaaagtaaacatacataattaaaatcacctaagaaacaacaaaactttgcgatgtacttcagtaaactactctaagatttatacaaagaaggctatgatgtaatttaacatgtactggtataaacttctttgggcaaaattcaaaatttcaagcgatgatgaataaagcataaggaaagttcatgttattggaatggagttctctgtttaagcatattatggacactccaatttgacagatactactctgatacagcttaataaatttgtattcagctgctgaaacactaacgagaattgagaagacctgggctgttggacctttgaagtccagagatttcaactctcagaacctggttttcatctttaattgatagaattggacaacctcaagaagagagtagtttcacttggagtgatggtgctgggctgctcatgaggattctgcaggttaaatgcagtcaagcactatagcacggtatcaggttatttgctatccatagactagataatagcaaaagtccttgcaaatttcaaagttctatgactcagtgagaacatttattatttagccagcaagtaagcacatagcccactattcagcatgtgtctgtacatataacatcctagagccctactactcaaagtgtgcgccagagactgacagcagcagcatcacctgggacctactgaatcagcatctctggggttggggctaagtaatctatgttttaacaagctctccaggcaattgctatgcatattaagagaagcactgattcagagcattgtgagaacatagaagatattctaggctttgcctcaagaactttagttttggataaaatagatgtaaaacaacttagcaaaatctttcataatgaagtaatatctgtaggtcattcattcaacaaatattgagaacctactatttgttaggcattgtgttagtggctggggttataatagttctgcttttgtgacgcttacaatctagtgaagtatacccaaataaacaaatatataaattttaaaaatacggtttttaaaaaatactatgcaggaaataataatggtgctatgaaaacaaagaacagaaatggctttgaggggtggagagtgatacatttaactttattttaaattgttaataataatatgttaagatttagttagttgataaatcagcaaataccaactgcatgcatgctctgcacccagataagcatcttgtggaatataagagtatgccctggaggagtttataatcagttggaaagataagatttaatcaccaactataatcagtatggtgtccgcagtagaccactttagaatggccctttgttgaaactctctcctctctgcttcttacttaataagcttttctggttttccaattcctggttttctaattcactgtgcaagacaaattttaaaaagagaaatcaatgttggctgaaattaatgcagaatgttctgtggaagaagaattcaagatgggtcttgaagcagtagtagaatgtataaaggtgaagataaataaggaagtcattttaagaataccactattgttagtattaataataactccaatcattttatttctaataactggtactgtcatgaaagatgatctgttaataccacatatcagaagggttttagttcagccccagacatgatacattgtgtttataagttttctttcattactttggcaaacaacgtcttttgattttaaccttcctttcaatgactaagggggactctaataagtatctaggtagaattgtcaaagaagatgagtcagtatttacatattgactgttacaagcactacacaaatggttgttacataacatacttgaaatgaaattagagttacctacgcaaatatatgtgtgtgtatcttgtttttttttttttaattgagagagagagggtctcattctgtcacctagactggagtacagtagcatagtcacagctccctgcagccttgcagccttgacctcccaggctcaagcaatcctcctgcctcagcgtcctgagtagctgggattacagaggtgttccaccacatccaactattttttaaaaaatttttttggtagagacggagtcttgctatggttcccagactggtctcgaactcctgggctcaagcgattctcctgccttagcctcccaaattgctgggattacagtcgtgagccaccttgcctggctgtgtgtatatcttttaatgttaaacttttacagtagaaatactcactatttgcttttcaattgcttgctctgaagagcacaatgctttactgaacagagatcaaaaacccacctagttaaacaggaaataagactaataaaaatatttaatggtcttatttaacaactatagaataaaactgaaaacagtacagtgaaataaagaaaattcctttgtaccaatgtcactgcatgatatcggtactaaacaaattgttctcaggagctacaagtcatattcaggtggtcagaaactttaccttacacaatgagaaatgtagtatctgaaatatctgcaactagttaggtttaagaaaagaaaactcttaccattgggggaaaataaatccttttagaaataggattgaactgtcaataaagctgtttataataaattcttataaagtttaacatgaaaggactgtaaaaacagatgttattcaaaagaaaatcacatctgatttttattgctacagcctctcactgacttttgtctcatttttcatggaggcttttaagttttaacaaaatacaaaattgaagagctttttaaaagaagagatttatgcgatgtatagaaagattttctggagttataaaatcctgatcaccagatatacttaggaaatgattaagaaggctgaatggtaaacatagactctagaaatgtaattatcattttctctcttcttttaattattaaaaatcttgcatttaaggtctgaagtttgccagactaatccaaatttactagtgagaggcatccttgaattctccttaatctgtttagttacttaaaatgtttaagactttctaatcaagagaagcctacagtctcgaaggcataatgttctctccgaaaccaatttaactttaggttatttaattggaactccaaagaattagaagttcattctatttccttggcattcttcacagcacctggcacagtgttaagtacatattagatgctcaataaatatttttgaaggagtgaacattgcttaagagggaaataagaggaactattaagatagaagatatttaaattcctaaaattatttcttccctattcatggagaggatatgattagaaagacaattgtatatagttttaataaaatctatttattttggttttgtttaatgcaattccacaagcttttactgagtttgcactatcttgacactgaaatgctgaagacattttaaaaattacagaatcactcaagaagcttaaagtttagtggtgtgttaatttgcagatgatttgattctgcttttaacttgtttaaggacagtgatctctgtttaatgccacactgaaagtactatgtgttcataataaacaatttctgaatgatcttatgagctcattagtatgtctcatgtggtttattgctttaaaatctcataatcaactatggtcatttttttctgcactagaatgtaggtcactgagctcaaatttatttcttatttttttttgatagggtctcactctgtcatccaggctggagtgcagttgtgccattatggctcactgcagcctcgacttcctgggttcacgtgatccttctacctcaggctcccgagtagctgggactacaggcacatgccaccatgcgcaggtactctttttgcattttttgtagagatggggtttcaccatgttgcccaggctgatctcaaactcctggactcaagtgatctgcctgcctcagcttcccaaatccttgggattacaggcatgagccatcgcaccccaagtgtatttctataccttacaaagtaccttacacagtaactaaccagcaaatggcagatactccagtcatagatgaatggatatgaatctactgttgaatactaatagaaattgtaacggcacagttacatttctgaaccaattctagaggttatacattcaaagaaggagtattattattaggtgcctaaaattgttagtaaaatagacctcttactatatttatctggattcttatatcatgcaagaaaatatcaataaacaagcatgccaactatggttttttttttttttttttttttttggtatccctccagatccagatccattttcccttctttttccaccttccagggggctgacttggattacatcattagactcctatgccctatggttttctgtttgggtttgaccaaggagaggactagcaaaccactgcagagaagggagagtcttgggtcagagtattgattcccttcatctctttttccctgagtatcatttcgaggcaaattctgtccttaagagaaagccactgctcctcccaaggcattaaaatctgcatgatgttttttttttttttctttttttctgggctctgagaaacctctctccccaacaacggcttcaggtctaggagaggtgacagctctgctgctgctagtcctagagtcttgtgctatcttgtgagatttccctacaccctgcccaatcctgagtatgtagtgccttgtaaataaagactcctcaacttaccctaatctgaatgtgccatctgtttcttgttgggactctgactgactgagatatcaacacaaatacaatcatgaaacaggacacaaattcagcacttcacagagttattgcggtactatgttaatgggcatgaaagttatcagtaaactgtaagtgccataccgatgttgattgctatcatttagcacaaactatgaaaagttcagactatgtccatacacaggtgtctcaacacaaaaccagttgacatggtctaacttgatataggattgatgtggctgtactgtaacagttgtccaataatcatgttgtaaataagtttttaatatattaacagcatactatattgatacatatgtaatcacagtgttatcagacttatccagtgttaatatggctgaccatagacaaggtctcaatattccattatccgccagtctgttccagatcgtgggccacttgtacatgttcctagttcggaatcaattaagagactagctctgtgaagagacgggaagcataacctttttctgagttataagtataaagtcagccctgcattcttttaccctgattggggctgagctacattacaaatctcctttgtctcttcaagcttaggggagcttgcaggaaattttctgttaagaatttatgtttttatgaaaaacaatgatactgagacacagagtgtatgctacgaaaaaaataaatacttttagggtaaaaaaggaaaaaggtggtattaaaataaattttcccaaatactgctctttatatatttcgttagtgacatctacacaataaccatattttgggaagcaattaaacacctcacatggacaaaaatcatatcggtttcttactatttgggctggcagtaccttataaaaagaaaaaagcatcaaggcactgtagtatgatatttttgaggatgtttttcctataaaaatcttcaaatgagctgcaaatggacccaaacagacttattttaatatactctaggaccatatataataaaaggtcctatactattttatagaaatggcttctgttgccttagatgaggtttacacataaatcttttaacttttagtgctgcttgtttcacttctggtggattctttttacaacaatgccctgccaagcagttaatactacttcataaaggaagacgccaccccttgaccttcacgtttgtgacccataatgcaaggtgcttccatcatctctatcttttctagatatcacccttccttggaagtgcagacaagtgttttgtttatttgttcttgttttgtttgaggtcaattcactggctcctttctccagtttttttttttttttttaaacaccttgaaagcttctaatacatctgctagccaaaacagtcattttcattacatgcttgtggctggtcaaaaagaacagttgtataatttttattttcttacccagaccacaaacaggttataaaaagtacatggcccttaaattttggcggttcctttaaaatttagttcaaaagccaacatgaagagtcagatggaatgactgtcacatggaagagctaccaagcagataataagtttagaactcttaattgaaaattaacacacctacattgtattcccaaattgaagaaaacggctgttttggctactgctataataagatgctgcatacttcacatgctgaatctggaagggggagcaattcagtcctatctgacggttgttcctaagctttagtataacttcaaagatgagggtatgaaattccgtcatcgtcagagagatcctgctttctcttccttgggttgcaaagttagtaaatattagccttccattttaactaactcgttgagcttgtctccaatagaagattgaattattggcctcaatcctttcacatccctagtagtatcatacattcacgctccagccatggcctcacataggtggaaagtattttcctaccccttgactttgggcttggccacaagacatgttttgtctaatgggctataaacaaatgtgacaagaggagagattttgaaaagtgttgtttgtgcttctgtcattgccttgtgctactctgtcataccccgagtagctgatgtcccttcagcttgagtctcagaagaaaatatgtggtatagacccgaacagaaccgacggcctagagataagcatagctaaaccatttccagccatgattggccaaaccctaccaaactgcagctccatgaataaatcaatattgttgttattagccactgaattaaatttttttggttgtttattgtgcagcaaaatggactgatatgaactgaaatgtggtttataatcaatacaatccagtaaagttctactaaatgtatgtctatcaagcaaaagaaaaaaaacagatgattagaaagttgtcaaattcttctaacaaagtccatatacataccaggtaccagaatgagttatcaataattgcctaggggtaagggttagaaataaaaaaagtcaagttgaacccactaggtcgtatttccaggttttcaagcagactgttctggtttgcaatatttgaaaagagtctgctgtggtatgctaatgactgtgaattctgtggtctttggaatagttccaaaatgctaagctcaagtttaaaacaaaattggattctcaaatatctttcttgctcagaaaggatttaagtccttttgtacagaaaggaacaaacaagtgataaggtaccttttgggctttctattacctatgtttccagagtggtaaaactggatctctcttgttttcagtcatatctacaggttccctcctaaggatgatccttcctggtggcttctgtttacaacaatgccacgccaagcagttaacactacttcgtaaaggaagactccactccttgaccttcgcattcttgacccataatgcaatgtgcttccacaatctctatcatttccagacatcacccttcctgggaaatgctgacaagtacggactgtgctaaagggtggaggctgtctttcacctcctgccaccaacagcttatttgaggagagtttaagaaagaagattttaccagaaaagttccaatttcatgtgcctctttatatgctttttctgcttcttatgtagtctccaaatttgaatgacagtcttcctaactagtaaccttggaggaatataggagaccaagtgaggaagctatcaaataatttcttaacatcaacattattgaaacatagtaactcattgttttacattggaggctaaatagaatgatatgttttaaaatggctatctccatgggcttattttttttttctcatctgataagtggattcaatgatttccaagattttgttttcaactctgtgattctatggtctctggatactgtagttccaaccttcaagagaagagcacatctaattaaagttcgagacagcgccaaaagattagcagctacggtcacatttaatgagcaagtcgagtgaaggcatttttcccattgtctaggagtcacctcaataggatggaagatgcacgttctatacagtcttatgaccagcctgttcctcagcatatttttcctttaagtaccaaacaggtatatgaatttagaatataaaaagagggttgtgataagttgatattttcttctccaaagtttaaatatttgaatagttcaccagctgtagctttaaatagtgggaaataatgcagctagaagaaccatacagggaaaaagagtgagttgaaaattctcagctcagtggttatcatcaagtttggttcctgtcagcctccagcgactgtaggtggtgcttataggtattcatcaataaaaggtgcatttgaggggatttccagcattttgcttcggaggaaatcatttatgtcaaaagattaaaactgctgttttcaattgcttaattgagtatatattgaggttaaggttagtgaaagtggtaaagcagaatgaatacattgcttattacagtcaagaaatgttatacagaaatgagaaaatgtacaaaccccaccagccataaataaggaagtggttagaatgtcgctctcagccaagggccctaagtccctttgtgtaggtttggaaaaatttatgcctgtctagcagcttgtagctgtggagcagagttggctgaccaaactttgattccttctctgaccatgttctgctagccttatgtccttcagtaaatgacagttgccataaaaaacaatgaggttgttgtatactccatcattcccactactttgagatcttaacaagatcacataaccatctgaacttgaagacacagactgaattcaaataattcaggctaagacatgtgctgataacctaagaaaaattattgctagactcctaaaataaatactatgagaaagaggccactttcacacatatttttagcttgaaaatgtgtatctgcatcaattgttaaaaaaaaccttttttttggataaatgggaaagtataataaattcaattttatttttaggacatgaatggatgataatttgtgggcacaaaaaagaataatttgctaagctttagtagcagtgtaatacattaaaatgcctgtatctcttgctctaaatgaatcaattttaaatatatatgaattgaatgtatcaattgagatcttaaaatgagcaatgaatgtggtaataccaggtacagataatttatgtgttctaatattatttagaaaagcatgccataagctgttcttagctaaaaccaccataattgagaaagaaatacttgagaagagattagatattctctactagttgaatggagcagtgaaaagtagattttggtgtcgtggttttatgaaaaagaaacatcagaaaataaagttctaaatcatttccattaaacaaaaacaaaaaacagagtttttggtatggcttggctgtgtccccaccccacaatctcatcttaaattgtaatccccataacctccataatccccacgtgtcaagggagagaccaggtggaggtaatggaatcataagggcagtttctcccatgctgttctcatgatagcgggatctgatggttttataaggggctcttcctacttcgctgggcgcttctccttcctgcggccttgtgaagaagatgcttgcttccccttcaccttctgccatgattgtaagtttcctgaggcctacccagccatgtggaactgtgagtcaattaaacctctttcctttagaaattacccagtctcgggcagttctttatagcagtatgaaaatggactaatacagtagctttgtttaagcaacataagtactgaaatgaatattcaaatataaatcatataggtggataaactgatcttatgaaatggggttctgtcatagtttttggttacaataacacacaacgtacaatgttattgattactgagttagctaagaggacttctcctgttataatattatacataatatcacaacacagttgctttcgttataaaataaagtaacatgtacattctatctgagattaagagaccaatggtgaatatattcctcttcatgggatcactgcactaaaacccacggcttttatttattttacaaaaatttctagttaatgatctaaggatttagctttttattttttcaccaaaccaaggtatatattgactggaagtattctgaaactattatataaaacaaaacagcttttgacttttttgtatcagttgtttgtttgaaagttgttcttcaagtgggaacatgttttcttccattttaaattgcagtcttacagatctgtagttttcttttcatggggacaaaattcgttttaagaactctggtatataaatctctggaagagagcattcacaaataaattccgatcaacagattgcatacatttctcaatcagctgtgcagactgagcattttcacggctccagtcatttcataaagatgattcagaattaatcagtcctactgctacttttattatttatatattcacagtattgacagatttcattttcttcccactctttactcctcctctataggaataacactcatgatgtggtgcgggcagcaggaagacctatcatctgactttctttctttaaggcatcactcaactaatcctgagaacctatgaacaataatggtggatatgcagattcacatcaaacttctgtttggttcttcaagtgttctctccagaatatgaagtccactaattctttagacctcagtagaggtatgtgaagcatgtagtaataacaatggctacaatgacacataaatagttatggctgcaatcgctataggtactggaacaacattcctctaggaacaatgacatcaagaagccttgcagagagccaatctcccagaattttgagcaatcaaactccttgtgacattttagaatgcactgcatcttctcttagggttactaaaaactacaactatacctaactcacctagcaacagttcatgccgctaattcattttaaagatacattaacagtagtcttttcatatgtctctttgaattgacttggctgtgtctcttgaaaggctcaaatttgattaggccaaaatgcagaggaaattaatgttattctcttgtgccatttccctaaattcagaaatgtaaagaaataccaatttcaaatacagacaagtctaatgttaaatgaagtctgaacatataaaaagattgtcgtcaagacaaatccattgcctggttttcttcagctgacatctatttttatgtagacggtatgacttagattcagggactaaacatgaagaaattcagaataatccaattattcaaaaggcatgcaaaaactattatttaaaaaatctcttttcacagtgtttttgttttgagtactatagctttgtaaacatttaattatctagctttatgggtttcgttttaatgattgtgccaacaaatgataacaataaatccatgccaattttggaagtatttctaatattatataacaaattggaaaggaattttgtacatgattatctctaggaagacaaaccacaagagtaattaacagagctatgattccattatcatcacaagggttaaaccagaagttcatgttcactattttcatatatctcacaaacccaagtatcagttcagttctcctggaaattcatgaaggattaaaacaaaacacattattaggcaatattttgatataaggagtgggtagctaatatgttttccaaaatttagtacagaagtgtgtgtatcatctcaagattggcggtaacacatgttacttacaaaaaaatgagcagaaataaacagtgtgtttatgatgtataaataaaatataatgacatcactagacaagggaacatctactttttggaaatttatttagggcagtgaaccattaaaaaataaaacataggctttatatttttatcatacagatggctaatattattaattttcaatatgcatttaggaaaaaccaaagtatatttactatttcaattagctattgtcacagtaatgtagaataaagctcaatggctttatgcaacaatcatttcttttcctggatgtgaatggctagtgcagccctgctgttcatgtcttttatcgttttcctgagaccagcagcctagatggacgtgttctcagaatgatagcagaagcacaaacaggaatgtatagatctcttaaggcctaggctgaaaactgtcacctctcactcctgctcatttaccatttgctaaagcaaatcacatggccaacccctaagactaggggttgggaagtacattccactcataaggaggcattgttaaggttgtgattgcagaaggtggagaagaaatgggattaatgattaaatctactacagctacataacagtttctttaaagcagatgatatattgtggaacatgacaatgatgtgtacttacttatatctttgactgaattcttcagggtgtaatttttgccacaatatttacccgtgctagatgattgttatgtatttttattgttatcagtgattaacctgctgctaaatttaagaaatagagaatcttactttttttttccagattcttgtataaggaattaaaagacatattttactggaggcaatcctttaacagcggatgtgagtataggcagactgatgcaatgtctagtctagggagcagagcatgccatctgagtcacgagtcttgtcttactcaactctggagttacttacttgaagagcatatactatatgggaattataagacaacactgcccctaaggagtttgggaaaattattttcttttccaatacaatatgcaagaaaatatttcacatcatgagatttagtcacttcctgtaagacaaccagagcaaaaagtcttcttagtcagatacaccatgtaggcaaactactctctcatcacctgtgcatgcacgtgtgtgtgcgtgtgtgtgtgtgtttgtgtacacattctgtctgtttccaattacaacttacttttctcatctcgtctttcaaattcttgtttttctggtggtgttccatttttgtaaatagaaaagtaaaagaagagtgtgcttaaaaacctgctcagagggtgaatttcaaattggcgtctctattagaggactaatttgctttctatgtgcaatcctggtgtgatcactgttgcatatgttactggatttcaactcctctgcccctacctaaactcattttgagactctcacatggtaggtcgatagcctgagttttatggagctcaaatgctgacatgacttctgtcagacttctggtgtcacatttggtgaagcaccaggagaatattctaccatatttctctttcctttgtttcactaggccagagtagtcctctctcccttgggttatcagactttacacactagcaaagcatatgattggcatttttctcttgcttattacccactccattcctctctctctgtctctctctctccctctccttcccattctccctctgtccttcctgttctccctctctcctttctatcctccctctctccttcacacttctcttctcctctctctgtctctctaaaatcaactaattattttccattttaatcacattcataagtcaatatattttatgtgcaaagaaatacatattcaagaaaaaagttcaaataagtaaaacgacaacaaaaacctgtttcagaataaaataatcttctttgctagaactaaccaagttctagctggtgtctttaagacacaaatttggctagaaagttactaattaatttgtaaaatatacctgaaggagttgtgccttttacgggatacttagataatctattcaccatcagtcaggggtgggtaataactctctgactactcttctgtactttttatcttatatacagtctttcagacagaatctatttcaatacagtaaacacacatacacattccaaatcaaatcaaaacaaaaccttttttccttctcttgattaactttacttttgagaaattgattataatgaaacatgtttaacaaaatgcatttttatgataaagagaagattccctaaatcaagactgagacataattgtgaaaaattcagccagtattataattggattaagttatgggattcaacctgaaaaaagaaatttttattctgatattgtaatttggtcatattaggctaagatataatttaatgtcatgagtcattagagtgtaacattgtactagtgatcatggctctgatggaggcatggacagtttttatgcaaagggaaaaacatgaaaatggtaatggaagcctttaggtgtcatctggcttagcttttccttttgtatcttcaaaacagtgggaagaataaacaatactattcttgattggctagccactggagatggggataccaaatgaaaaaaatgctccaacacaagcaggaagtattattttcttcatttctttatcctgcaaaagcacagagactctgtcttgcagaatcatttttttttttttcaaatttcagagctgaaagggccataagcaaaacatctggtctagtggttctcaaatttaagtgggcacaagaactacctaggggctctttacatatgcagattccacgacccatccccagagagcttctgacacaatgcatttttaataaagtttccaagtaaagatggtgtccgtggtatgtaaacctggagaaacatatcttttacctagatccatcatttttcagaagatcaacctgagatctccaacagcactgacttccccaggattacagaggctagtgtttaggaacaggaccctaacttcttgacttaaaataagatattttgcactctctaaataccttaatacttctattaaaaaaagttttagagtctgttagctgaagaagctgtgcctttttaaggatacttaaaagcgaataggcttttccccatttttgtattgtggcaaaatatacacaacataaaattgatcattttaatcatttctttttgatttgggatcttgaccatgctggggtacagtgtcattcactgcttcctccagttcctgggttcaaggaatcctcctgcctcagcctccagtgtgtctgggactacaagcatgagctcccacacccagttaatttttgaattctttgtagagatggggccttgccatgttgcccaggctggtcttgaactcctgagctcaagtgatcctcctgctttagcctcccacagttctgggattacagaagtgacccacaatgcctggccatttagcctttaaattttttttatgggtacatagtaggtgcatatatttacggggtacatgagatattttgatataggcctacaatgtgtaataatcacatcaggataacggggtaccattttcttgaccatttttaagtatacagttgagtactattaagtacattaatattatattattattatcgttgaaccatcaccactatccatctctagaatgttttcatcatcccaaactgaaactcaggtactcattaaacaataagccctcattctcttcttcctccagctcctggtaacatccttcaactttacgtctgtataaatttgactgttgtaggtagctcataccagtggaatcatacaatatttttcattttgtgtctggtttatttcacttagcataatgcctctaagattcacccatattagctcatcttttgatttgctgaattcttttaacttcttgttcaagatgatgttctggctctttaagaaatgaatttctatcatttgtccaacttcaatagatagctgctaaatgagagaaagcattcagaaagggcattcctgggtgaatgaaatagacagagcctggaggccggcatagtgatgtgaaatgcattttctacttagttgaaagtcacttgaaaagaaaaagaaataggaaataagagagacaggaggagaagagaagagagatgaactaaactgagaaaaactaagactttcttaaggctgcgctgtgctcagattagtagggctatgcaaatgaggttattaacaggtatattctaaatattaattggtacacactggtatacatggaacccgatattattaaaatacctttggggcaaactatagacaaagaaaagcaaataaagaagtgaaataaagaagtaagcatctatgttgctattcgagaggtatttatcgtgcttaagatttaattttaatttatatagttactgtcatgagcattttgcagcttttaagtcagaagggaagttatttaatttatgttttattgtagaaaaaagtttaaagttttaaaaacatcagtatactggtgtatctccaattgtacacttagaggcaaggcctggtaatgctttcgagaagaggtagggctttggccaagagttgaattttccaggtagacaaggagagaaagggtattctgagcaaagataacttctcttgactgggataatgactacttgctgtttagtattcattcagctcagtgtcatttataagaaactttgtatggcagctttaattaaatggcatcaaaactttttgatacttctccatggaaaggtggagtttatgttctcatccccttgaatcagagctctgtcactgattgacaaatagaatatgggagaagcaaaaccattcttgcttttagggcaggccttgagaagcttgcagctttaatttcttgtcccttaggataattgctcttgggacccaactcttacactgtgaaaaagcccaaactgctccatggagaggtccacatgaagaaaaactgacagtcagcacctattttccaggcatgtgagtgagccctcttggaagtgaatcctccagcatcaggcaatctaccccaactgatatcaactgaaacagggataagcaagccccattgaaccttgagcaaactgtagattcatgaacaaaacaagtaatttttactgaagccatgaagttttgggctggcttgttatgtagcaaaagttaactagaataccttctctgatcttactcataagggatgcagaaggtgccccttctcttggatgactaaaggactttgtactctattataatatagcccttccttccttggctaggtctctctgtcctcctgccccaagccccaccactattaattcctcttttggggtagttccatatcttatcaacttgtatattttcatgcctgtttactgttctgtagaagatcccacttcttaatagctcttcttaaaagtcacattcaggaatccattcaaaaagtacattttccactacgggtatatattgcatgaatttcaaaatttctttcaggtcatggatgaaagatgaatttagggttgtctaatcaatgcaatggttgcatccaaataagaacacttgttttccactccaaaagagaatcaacaatttaccataccaggtgaagaagctacctctactcattgcactttttaaaactgcattgcacagccattttccaaatatttgtaaagctactgcaaaaactaaaaaggatttatggagtaaatcatgggaagaatgcctggtcaagtggttcataaatatccaggtctcattctatttggggtcacagccttgaatttaatccaatattgaattgttgaattgggagcaaagaattgaggtgaaatgtggttggctcctgagagcaactgaaatgctgcttcctgcagagaataactttctttgtaactcccagagaataatatatttgcaaaggtgttggaggtgaatagatattagagaggaaaaagtaaaatctttagagaactgaaagattatatttatgtgactcagatcattgtaagttattataatgctaatattgaatagtcaatagtcaacatgctaacagacctctcaaggacaaccacagactcaggagcaaacaaaagtaatttgttgctttctcactatcaagaaacagacattcttccatctagactaatatgatctccagtgggaaatgatttatgtctcttacattcatgaaactctctctcataaccaggcgtaatgacttcttttacctcttcggagaatggctgatttatgcacagacctttgtgcaataacttttctttaaagattgatgctgttaaacatgaaaaaaatgtgaactttctgacattttattttaatataatttagaaaaccatgtaaactgcaaaaggacctcatgtggaatgaaaatcacatgctgataacctaaattattttcaataccattaatctttgactaatacctggaatgttttattatcagaattatgaaaggcacaagagaggcactaatgtagttcatcttaaaaataatttaaaggacttaagattctttttttatcccctcaatttacactttgagaattttccagtaggatgggtagtgattgttacctatcacatagaggaatatcattttttttgttttggtctagaaagtctgctcccaaagaccaataaccctaaaaaattattcaaggttagaggaagggaggaggagaaagtgacacaaaattctttgacatttttctgtggtcaaacttttcctgaccttttcaattcttgtttggagaagaagttctgaaattatgtggatcttgtccaggttctaatggagatcaaagaaagttggcaaatagtcccagccttctcaatgttttcattgccactgccccatggtatgcatttaaaacaactttattaattttattaacgttatctatcagtcattggtgtgatttcctgtgttactcaggatgtttgggaaaaagaaactccttttaccaaactgtgtttcaggcaatctcaactttggtgtctgattgaaagagaagggccaagtcaatgtattttcccaaggagggcattatgaaagataaaatatctctcttacaattttcagtataatatgtttgttatcatgaatgagggtattcagccttgtttatatcccaagactttaaagagcttttccaaaacgagtcaatatgaacgcttaagaactaaaatttatggaagattaacaattgaagctttctttaaacaaaatggattttcaacactcacagtaaccaatatttcaagcatagtttcattcacacgtctatttctttctaagtagtttctcacacaaatcaaatgagaattgtgctctcaaggtgatagtgaaataaacaataccaaagtctatttatacatattgacataaaattacatactatatgtatacataaaaataagcctgaaaatagtaataacataatattagctatgtttattgggtgcttaccgtgtgccagaaactgttccatgcacttcagtacattaattcgcatcaccctcacaacaacctgaagaggtagctgtcattacttttgatttatgctccataatctgagagcaattcagaaatgcgtctatggtcagtaagccccagaatcacgatttaaactcaggcagtcgggcttcaaagttcacactatgaaacactatccaccccagcctctctctaatgcaatgtcagaagtactaaacgtcatttaaagtgcagagaaatgcctataggaattgagatggagacaagatgtcttccagcttgggggctcagggaaaaagggaagattcgaaaatggctttccttgaaaagtaggtaatgtttgggtaagcttagatgaaaaaaaggaatctcaagacaaaaaacaagatcatcgaaagacacagaagtaagctggctagctgttcattttagtaggagttgaaggtgcattgagaggtaaaataagaaataagattggaaacgagactcaggggcaattgtggagagccaggtgaaggagtctgtagaatattctgaagggctttgaagtcaaaaaaggtgtttgaagaggggagtcatatattattttcgttcactgacaaatacttattgaacacttttcatgtgacacacacagtcttggacaatggatatatacaagtgaataaagcagatgaaatctttgctctcatggaatttgcattgtagttacaacctaagctatgttttaggaagcttaatttaaatggaaatctgcaagttggattggagccactggtgggcaggaatgagtggaggagggtaaaaaatagtaagagtgtgaatgagagtggaggtaaggggctagtgagaaaggaatggtcataaagaattagggaggcagaatctacagaccttaaaaatgaacttgaaagtgaggcaagtaagtgggagatttagaaatgactatatgatctgaactctctgactgaaaagatggtaccgggatgaacagcaggataggaaataagacttggtataaaaaatggcctatttgggtcatactgaatttatgtcatttgtgagacatttgagtaagaaatgtcctacatacagtaagaaatgtgggacagacattggaaaggaataaaaatgttcaaatcattggattaaaggagatggagaaaagactgtttctagtataataactaacacataactgacagtaactattgactaaatatcaaatgaagataatgagattaatgaaatcagaaaagaatgcatagaattgatactgtgggcttggtgtggtggctcacacctgtaatctcagcgttttgggaggccggggcgggcgcatcacctgaggtcaggagtttgcgaccagcctggccaacctggtgaaaccctgtctgtactaaaaataaaaaattagccaggcatggtggaaggcgcctctaatcccagctacttgggaggctgaggcaggagaatcacttgaacccgggaggtggaggttgcagtgagccaagattgcgccattgcactccagcctgggggacaagagcgagacttcgtctcaaaaaaaaaaaaaaaaaaaaaaaaaaagtcaaaaaataccagatgctggtgaggttgtgaagaaaggggaatgcttataccctgttggtgggaatgtaaattagttcagccactgtggaaagcagtttggaaatacctctaagaactcaaaactgaactaccgttcaacccagcaatgccattactgggtatatacccaaaggaatataaatcattctaccataaagacacatgcagctgtatgttcattgctgcactattcccaataccaaagacatggaatcaacctaaatgcccatcaatggtagatcagatatagaaaatgtggtacatatacaccagggaatactgtgcagccagaaaaaagaatgagattatgttctttgcagcaacatggatggagctggaggccattatcctaggtgaaataacataggaacagaaaaccaaataccatatattctcacttataagtggagctaaacactgagtacatatgaacacaaagaagggaacaacagaaaccaggatctactctagggtggagggtgggaggatggtgaagactgagaaactacctatcaggtaccatgcttattatctgggtgacaaaataatctgttcaccaaactcccatgacatgcaatttacccatgtaacaaacctgcacatgtgcccctagagcttaaaataaaagtgaaaaaaaaaaaaagaagaaagaaagaggaaggaatgagtgcttagagagacaaggagacaattagtataatatatcaccctggcaagtcaaaaggtgagacatttttcagtaggctgtagtgagcagtaataacaaaatatgagtagatttctagggcaatgaggacttgataaaaatatttgcatttggtagttatggtgatttcatagagaagtgtttcagttgggaggcagatgtagaaacttgactttaaaatgtaaaggaaagatggatgtttaggaagtagaaatatttccactaatttctattagatgagtgatttgaagcttgcttttggtgatcttgggtctttccctgtaatgctgagtcaatgtagagtaatgggtaggacagtagagttggtagaagatcagaaagtcaaacttaggttcaaatgctgacttttctatatattcgggttgagcatcccaaatctgaaaatccaaaatccaaaaaactctaaaagctgaaaatttttgagcgccgacatgattctcaaagtaaatgctcattggagtatttccaattttgaattttggggtttgggatgcttaacccataattataaagcaagtaatccaaaatctgaaaaaatctgaaatccaaaaaaagaatcagaaaaaaattgatatccataacacttgtggtcccaagtgttttggataagggatactcaaccagtacttgtgtgttaccttagtagaagttacccagcctctcagtttttcctctgtactaaatatacgatggtattacatcatgcaagcaaagcacttagtacacaccttggcacatagtaactattttaaaaaggtagctattattattattaccccccttaataattgaaaaatacatgatgactttaatcccagaaaagtaaacatttattgtgacaagcttttagtttatataattgccctcctaactgggagtaataaaatttagtagttattttaacaagtagcaatagataaattacttaacctctccaattttattcttctcaaatgaaaatggaaataataggagtaccaacatcacaggttttcactaaggatcaaattagaaaatgacagtaaagatactttgccaattatgaaacataaaatatttagttattattctttattaattaatataactttgatccattgacttttaagagcatcctattagatttacatcttcagtttgacttttgtttaatggtaattcataaaattaataaggacctttcacttgaaagctttttcaaagtgctttcatatttattcccttataagatcctcacaaaagctctgcgaggaataaaacacaatggttattggaggctaacaaaattgacttttcagtatgcacagtgtcttcttaccaatgtgggcttttcttttggtttatagatataaaattacaaaatccaatagttaatttacaaagttattcaatttagtcattactttgtatcattctagataattgtttaatgtaatggcaacatccagaagtaggttttaaaggttttaatacaattaacatgtttacgtatgaatgagacatggttcatgttaccatggtaacatggtccaaaacggtacaacacttaaaatcaaatagctaaactcatattgcattaaattggggtgactggatgaaaaatggattctaattttctgcattcagtctttcttcctgcaggagataaaagaccagtcctgaacatttgtccccattgactcccttttctaaacttttaattattttcattatttcatttcggattttctctgagatctacaggaattcagggtcccaaaatggaaaataataaagtaactaaatatagcaagaagacaatcatgtgagtcttgagtattcctgagcattatagtcagaggttctcactgaacaatagattcatgggtagaacatgctacgttcaattgaactggtatctatcgagggtagagacagtagtattgtgaatgaggatggggtttttatagtatcaatatgagaataaaaggaaaaatgaaaatttccatgtttatataagaaaaggaactaattatcttattgaaaagagtttttcatgatcttggatacattatgcaaagacttttactttttccatgacataattttttttttttttttttgagatggagtctcactgtgtcacccaggctggagtgcaatggcacgatctcagctcactgcatcctctgcctcctacgttcaagcgattctcctgcctctgcctcccgagtagttgggattacaggcgtgtgccaccacacctggctaatttttgtatttttagtagagacggggtttcgccatgttggtcaggctggtctcgaactcccgacctcaggtgatctgcccacctcagcctcccaaagtgctgggattatatgcatgagccaccacgcctggcccatgatatgaattttatgccaaagctttgctaattctttgcctttttcacaattagtttattaagagggtccctataactgtctttttgaataacatggacaatagtatcacttaataccaattctgtactacagtaagtaacattttggtgacatttagatatatttctgagtggaccatggagaaattcaaataacgacataaatttgtgtgtaatataatttatttctatggcttccatgttgatgtccttcaattttaaatctttaacccagatctttttccaaaccttagatttacattcacaactgcttcaagagaggtaaggttttcacctctgatttttcacttacagatacctcaaaatcaaacacgttcttgactttgctcctcacaactgtttgccatcttgaattctgcaactcatgattgagtgaagacactaccttcagtcaatcatgccaagtggtaagcaggcactgatttctcattttacctcacattttctgctcacctccacctcccacaaaacatatgacagtgttgattttatctccaaatagctcacgtatctgttttgtttgttcaacctcaccactttgatcatcaattcttgcttggcttattacagaaataatgtcctaactgttgtccctgcatgggtctcatatctttccaattcattctcctaaccactaccagaatgatcttttaaaaacatgtctgattagtccatttccttgcttagaactaggctatgacttaaagtgataaaagtccagagtctgaaaaataggtggcaaggggcagagagagccagcttacacttactgagcccttcgagtccaatagtctgcctctctggtatgcattttacatatatcttatcatttaaacctgataaaatcctgtgatgtactcattgtatagaagagtaaaattgggactcagaggtcagacaataagctagtaagtgctaaataaggggtcttcctgcttacaaggtccatactctagctgctacatcatgctgtctttccacataatttagccccagttgatctaatttcatttcttgtagcaaccataccccagccaagttccttcagattctcacactaccacactgactaagcctttggatatggtgtttcctctatcacgaatgctcttttcaaccccatgaacctaaataactcctaacaattcttctaaggtgactttctctaaacagaggttctcactggacaatagattcatgggtaggacatgctatgctcaattcagttggtatctattgtgggcagagatatttttaaaatctcccccagtgcataagcaaggttaaaatccaccgttctaggtgagtttcctggcctctttggaaggtttagcctagtcttctgtttttgctagaccctgtccagctctctactgtaattctcataatgctattataattttgtcttaggatgtatgtcttcacctctggaatgtgaacctctcaaaggcagaaataatgttaaaatacagaggcttttgaatatatgttacaaagtgatccagtatttccacaccgacagacacacacacacacacacacaaatacacacacacacaaaccaccgaaccaaagttttacgaacaatattgaaacttacttaaaagtgatggactccttatttctattctattttactaatttcattcatttctatcttaaaaatatggattgatactcattaaagtgattatacaacccagtacttttactgaactgtttttgaaaagcacctttcttggggcccttatgatggaattagttcccttataacaagaggaagtgtcatcagagctctgtctctctttgctatgttaggacacagagagaaggaagccatctgcaaaccaggaagaggggccctcaccaggccctgatcttggaatcccagcctccagaactgtgagaaataagattctgttgtataagccttctttcccttacccaccccccaaaaaagaaagaaaatcatctctctgaacatgtttgtatcaccagacctaacaccacgacacatggcaggtgtttagcaaagatacgctgaattaataaaagttctcagaaaaattttatatatatatatatatatatatatatatatacacacacacacacacacacacacacacatatatgtgtatataatttttaaatatccagagcagaaggcattcatcgccaggcaaaataaaaatatcaaaattcactttcacactctttagacaacaatcaaaatagaaagattaaaaaatacatataaaactcaattcaaactaaagcaacaggaaggaatacactaaaggtttcttctccttagaattagggatccttaaattgcctctgcattctcagatagtccaagaaatacgatactccaatttattcaaggtactaattgtgctactaagattgcattctttcttctttcttcagaattaatccgtgcgccaaaattttggtgagaaacttctccaattttattttattttattttaatttatttttttgagacagagtctgctctttcaccaggctggagtgcagtggcgccatctcggctcactgcaacctccacctcctgggttcaagcaattctcctgcctcagcctcctgagtagctgggactacaggcgtactccaccacacccggctaatttttgtatttttagtagagacgggggtttcaccttgtggccaggatggtctcgatctcttgacctcgtgatccgcccgcctctgcctcccaaagtgctgggattacaggcgtgagccaccacacccaattttaataacatattagaaatcaaagatatcttaattcataggtgtactcagatgtacaattcaaactttatgaaacttgtctctctggaaatgttttattcatcagaagacaatttttataatggggggattgagaggagacgtaggtaaaacacgagattagggaagggagtgatttgaaagatatggcctgagacatgacccagatcacagatgaaggtatctcatatatttattgctccttagtttgtcttgctgagaaaaatatgttaattacaccacctttatgaacatcataaaggtcaccacatacccacacccccacattgtctttacaagctaatattacaatgatctctcaggggtacttagagaaccacttaatatttgtgaaactcttgtgaaatattcagaaagacagagtctttccattttcagttagttacccagggttttatggtagtactttgaaccatgaacagctttgtcaactcttcttaggcccaaagcagaaaatgttttggatagagaaataatccgattcaattacgaatatagtttttttatttaaaggataaatctgcaatttaaaaatcctgaaactttcacccctaaaggctttgtatggcgttctataaaaatacatttgcttaaaaattccagttagcatatcagaaataacaatatttataagaaacacccccttatcctgaagtacaaggacgacggtaaagttcttgattttagtaaggaaagtgagttacacctttttataatacgggaggaaattctaatgtctttcagagaagaattaatcatgttaattccattcagaatgtatatgctttatattacatgtatgtttaaagaatctatgaattatgattattgctgagagaataaatatcttacgaagtggctgatagacgaaagtgataggtagtctagcaagagctggagtctccatatatagaaaaacggattgacagtcttagagaaaaacacattttgtgaaggttttcaccctctctcttcattcactagcatttgtatgaagtaaatcatcactacttttggggtagacagatatatcaaaatctgttggcagagctgttgctttggctaggcatttcaaatttcctttttttttaatatatgagaactatgattgctatacagcatgaatctatgaatacaatgctaccagcttcttcaaatgaagtgaaaaagcatgccatttcacttttctcctacctacatattatagaaaattccttttgttcaaaataaaaattcatagaggaaaaaaagcaaacacttccatttagctgaaatactgaaattgcatgtaatctcttaaggtatgctgctttatttattttcaagctcggcatttccatttgttgctcttcaacaccagtttcttgactcaattcaatcagctgaaatgtgccattaacaataatcaatagtttcagtagttcaccgttttaccatgacatctccgagtctttcatcaaaagatcattatccaaccatctaactaaaaatcaggagttggctataaatgtcatttcaatccataaaatgtagtttaaaccttgggcaagtggatttatagaaaatacaatattagctgccagggaagagggaaactgtctctgttttaaaataattttggaatcttagttaaccttattatagttaagacgcaaatgttgaggttttcagaggctctatgggagttttatctggattttgagaataaatgtagtttatcactttggggttgagacagtaaaaagcccctgccttattcccaagctctctctttttctacctcgggtacactgaaagttatgtgtaatatgtgccttagctcaaagatggaaaagagtagcctgatcgacactggactttatgtgagcaacaaataaactgtggtttggttaagccactggacaaaaacgaataaatacattttcttgagtaacatgggataagctaagacattttctcagcataatttccaactgcttttgaaagagagatcagaaatctaaacataaaatatttattttccatgcttccatagtaaatatagttaggacacatggtgaatcttccctttaatgattcagaagcttgcagtttcttgagattagaaatagagataaattttcattatataatacagcagatataaatacaaattgtatagtagaaaatagacgtatttttgccctcaactagatttaaagatatgttttattaaatccctgacataaaataattttttagtcattgggttattctttatttttcaaagtaatctgctaaaaatagactaaaatagacttaatcaaagcttattatttacctaccatagctgatgggtaaaatgtaaacccatgtatttttatttatttatttatttgttttgagatgaagtctcactttgtcacccaggctggagtgcagtggcgccacctcggctcactgcaacctctgcctcctgggttcaagcgattctcccacctcagcctcccaagtagctaggattacaggcgcaggtcaccatacccagctaatttttgtatttttagtagagatggggtttcgccatgttggccaggctggtctcgaactcctgacttcaggtgatccacccacctcggcctcccaaagtgctggggttacaggcatgagccaccgcatctggccgggaaacccacatatctattaaaattctggagtagctttatcagcatttataatattttataataaaattttatttatgaaatagcctaagccaaatatattacagtggtacattgtctaaccatacatcgaagagtgagcaaaaaactctacatttgcattgcccttatattctatcacaagccatgggagatatctataaagtctgatactgttccaaacaaattacctccaaatgatcaaactaactcaacacgcattttggaggagaaagtggggtcaaagcaggatgatgaagcaagaacgataaattcaggagccatacattgccactgttacgtactctatgcaacagagcagcaaagtagatcaactatcatatcaaaaaagaaaaacaggagaaggagaacgataggagggagaggagaagaacttctgcttattatgatttgattctggaattattcaaactagaatatacttttcataatagtttaaaaatatcataatagtttcataatagtttttcataatagtttaaaaatatcaaaaaataaagttagtctaaaaaatcaatcatcttattataatgatttatatccaaattgtatttgagagactagtaaagttattatatcaagtcagaaaaaccaactatacataacaaaactccataatagttcaggaaaattatatcaggtattgagaataaactttaagagcctccttgtactacagaatatgattctcaccaagacttcatttaaacaaaactaccccacgttctgttttcactgtttatgcatatggaactttatggaaataatttttgtttctaggaaaaacaattgtctgaaaattgtttgatcattaactacgacaaattcagccatctcattcttattttcacagatcatgttaggaagaaagctacaaaatgccagattaacatttcaaaacatatttgaaagtaatgaagggaaactgattcagttagcaacgctaaataaaacagacaattcatacagatgctttccctgtaaaatattaaataaacactcaaaaatgtcaacttttaaaatttaataaaccaatccctaagttatttctctgagcaaagtttctccttgaccgaagctctggttttatatgcaaatgttttcctggtcagagcatgtactttttctaagacgagggtgttaagtggaattataaatgatgtttccttctccctctgcctctctcctccttgtccaaataccgaaatacatcaggctgtataaaagcaactattttgttttgtccctggcttgtcagttacaagtacaaatgctgagaattgttcaattggatccacaagagtgctaaagcggaaatgcctgacttacttgccattgtttcatcagctcttttactcccttggagtcttctaggagcctttccttacgggtagcatcctgtaggacattggcagttgtttcagcttctgtaagccaggcaagaaacttttccaggtccagggggaactgttgcagtaatctatgagtttcttccaaagcagcctctcgctcactcaccctgcaaaggaccaaatgttcagatgcaattattaaatatcagaatggtgcacctagtgaactccataaaaagagaaagatggaggaactaaattgtaatataccaacaatggggtgagttgttgctacagctcttcctttaagcaacaactataatattgtgcagtctatttactttcatttttatttaacttaaaggcgtttgtatgggggaaggcatgcaagaatgacaattacagatttctataaacccctctccacagaggaggtttcatatatatatgtgaaatatatatacatatatttgaacatgtgaaagttcaaagtacctttttttcaattttgtagtttttgttggtcaattttgaaagcttatttttaatatactgccaaatttgagacaaacctttatagttaaaaccctaaaatccctgtaccatgcttgtctttgatgctgctctgaggcagaaaacaaggatttgatatgcaaggagaaaagtcaagaaaatacaaacctagaatcaaaaggaaaagactagaggaaaagacaaaaagaaggggattggagggcaaaggaagaaagacttaacaagtaaagaaataacatttcatagaaactatcattttgtgcaaactatcattttgcatgacatcagttataattattgtgttagtttcatatttaactacttgatcatacaactgagaacattttccaaaataaaaatgttatgtgtaatgaaaaagagtagagttttaaaaactaggcagatctgagttcaattcccagtgttctttaccacttacgtgatatggcaagttccctctctgattctcagtttctcatctgcaatatctattgctgtgatgagaattaaaataaaaaattcctgtgaagttgagtgccccacgttatacagttatacattacagttactcaaaaacattagttccttctacccatatcccatttccccattcctgtaatattttaaaaagatgaaacaaactctttcatgacaaaaactctaaaaatgtattcatatttttgatcatatatatatatatatatatatatataaaatgcatgtattgtggatacacacacatatgccctcagcaaatatctatataataatagcttagaaaggaaaattgccttaggcagtaacagtcctatggaaaaagattcaggtaaactttgtctgcaatgaggaaattagtactctatttaaatgtcttatttgccttctattactacacaaacactttctgggattaaacataagctaaaaatggattttaaaaaattgaacacttgaatatgatacacattgcttgttaagatgtgattgtcaataattatgcaaaactgcaatttatttcagcagcaactttatcatgggatgtgcaaaccaggcaataaacaactcctgccgagccagcggcagcaaagcccccggaagagctgtttattcatcatgggtgaggtttttgctgagcacacagtcttccacagtggagtttcagtgctcatactggataaaaatcttctgtctgcattaactggtggagggtagaataggtttatgaggatgtagctactggaaaaaaggaagcattgcactaagctatttatcaactcctaaataaactttaatactgcacagctgaaaggtagtgtagggttctggttgggcaaataaattaaacctcatgtagttcaagggctaacgtggactgccggctccctgcttatctagttttcaggcaaactatcaatgcaaggagaaatatcaaaagagtcatttatctttttatgtatcatgcttgaaaaattcagaaccactgcaacaactccacgaatctcaatgctacaattgggcatacaccttacagtttgaaccatgtgtaactgctgacaattgactgggtgtgacctataaaagtggcagtttcatgcagtttgcattaagacttactccatctccagtgcaaaatttggaacagaaataagctgtcacattccagaatataaatgcagggttagacatttgacatattttctaatgtagtccaatttcaaacaaaatttaaaaatatgaaattctcccatggcagagtgaaacttagagaatgtaatattgtgcattttatcagcatcagcttcatgatgagctgcgcttgatgcatcttagctcctctatccttaaactagaaatgccgcttaccctctgcttccagagaaagtaactagtaaataactttccaagagttatttgcaaaatgcaatgcacataaatcagatgaaagagttctaccgagacaatgtgattttcagccaaatcctaccagcaagtttgctgctttgtaaattaggcccttagggaagaacagtaactctttcaggacagtaagaaaccattttcctaaatgatacccttgtggtctgaaatattgacaacatcaggctgaatattttctaatttggaaaatacgttaaaaattcgatggcaataacagcagaaaatctcctcaaatgagctcctttacgtgcctcttgaataataggtaagactgttgtttcctgcttgtgtgggggttttacggcttcaacatttctctcggaatctatgtgtgtgtacgttgaatccctaaattttaattgtgccaggtctagtctagaatgagtcaagaatacttaatttccatatctgtgcattcaacatgctctaaatgtatcatatagttttaaattttccggaaccatatgggtttaagtggcttatatgataagtaaaatgtaaaaataagaatcataaagaaaaaaaagatatgttcagaaaaaaaaccaaaggtcttgaattagatttttttttaaattcctttgtccaagttatcaaactacaggccctggagaaaatttggctgaattttacaagtaacaatgaccagatattagaaactgtaataatgctttgcaaacagaatctactgtattggttaagtacttttttacataacaaagttttataatcagctattccagctttatggtgcacaaaaatagctgagaatttgatggagtaaggaataatgtgatttcaaaaggttttcattctattcataagagcactgtgtaccattctcagtatgtaaataagggcagcatgaaacagtgttctcatagtccatggaccagcagcaccagcaacgtctgagaagttattagaaatgcaaattcccaggcctcagcctagctctactgaatcagagactctgtgggtaaaatccggcaagctgtgttttaacaagccttccaatatatgctaaagcttgagaatcacagttgccaggaaccagatttgagaacgactggcatagtagatgctaagctgggctgcccggaccccttttcaggactgaaatacttctgaccccagctgctggtagtgctactggctgacagtcctcagctgttattcctgtctgagagctggactcagctaaagagaggtgcctagcccaaagttacccactatgtccccgagacgggctgcacgtattggttgatgggagagttgtggggtataaaatcctgggtcccttgctgcaactcaggacaattctgaagggctattctaccttcagacttcagagatcctcctggggaaggctaggaaggagaggcggagggttgattgtgttgtagttgtgactgtatggtagcccagcttctccttctgcccaatcctgctccctttcctttcctccgctcacaggtgttaatcctgagagcactctccaataaaattccttcatgctaatcactttctcagaatctgctttctgggagaacttgacctcctgaattgtcatgctgaacaaggattttaaaaatatacttgcctaagaaatatatgtggtctccaaagggaacaagatggaggattctcacatgcagtaattgtgcctgaattgctactgaacttttggttgccctttaaggagacctatagataatacaggtttgcattatcatcagttacaagcaagaatctactgaaggggcggagtgttggagctataaagcttagtgcaaccctatacgtgccaaagaaagtgtttatccagagacaactgcacatgaaggtaaagaatcacagaaggcatgttttcagcatacccattttctttttaagacctgattatcaatgaagaaatcaaataagtaagttctgacctgtcattagaaccctactcccgccacacacacacaccatggtatttctgaataaatctctaagactgcattgagttgaatatcatcaatttcttatggccaacataatacataaaaaggaaaaaggaagggaaacttgttgctttccggggtaagcctaaagagcttaattattgtatacacaccattctactattagatatatggatgaaaaatactttatcggtgcattatactgtggaattgtaagtgtgtaggtataattacagaaacatattgagtatttttagaaaaaggctcaatctgatatgaaaggttattttgcccaggttatttttaaaatgtgataaattaggaacattcaaagaactcagtcttctgctaaataacactttcactatggcctggcattgttatagagtaatcacataaaatactctgaatctttccttcctagtttatttgcaatttagccactatcatttcctatgatattttaggagaaagattaaaggatcattattttgttcctttttttggtgagatataggtcagagagaccttagtagcacctggatgtaagatcaaaatgattcttgccatatcaaccgctactcatagaaccagagttaatctgaaattcaaatttcctgtaaccataacagttcctactagtttgctagtaaattgcattttgattttaaaacataactttatattgtacttgtgaggggaagctagaattttgtcacctatggatatacagcactttgtagaaaggattccttttaatctctagcaattctattagtaacgtgcactaatgagaagcaaaagctgtcaacattgcctggattagtagtccattcctagcaaaaccaactctgtggttttatctgtttttgggcaacatctacctagaaatatgactggagaagggtggtggcaatgagagaatgtttctcttttctcctctgttatgaaactgtaaggcgaggaatatatgacatcattttaatttaacttctgatgcttgcttttcatccacagcatgaagaatggcagatctaatgtacagcatggaagataatttttaaagctaacatccacataactctttatatgttttcaaacatattcagagttattctatcatcacttcataagatattttccatttttctacctaccttctttttctatgtatactcagctggatatttcattctctgccaatggctttacactcgatacagattatctttaattctgaacctcattcttatttccacatgcctaccaacatctaattcaataattcatccatgcatccattccgtacctattgtgtaccaggatctgtgcctgatgatggtgacagaaaatccaataatacatggactttggtatttaacatattcaagtttaacagagggtacagataggtaaacatttaactagagttacaatgtaattaaggctataaaccatctggagtccttcccagtagctcaaatgtaacatatatcaatctgctttcataaacttctatctcaatttgccaaacaagtgataaatgtatcttaaacatgttttactctttccatcaaaagaggtggagatcatccagcaaggctttatctcaaaatagagtgatggatgcttaacaaaagtttgcctaactaattttcataaaaataaaaaaccttttagatatacagtacaggcttttgctggtttcattttagggctggagagattgattctgagagaattgtaatgatgttcccaaggttgtatacaagttaagtggcagagctgggggtatagcccaagtcttgcattctagaaaagaagtttttgtaactctgaagacagatattggaatacactcctctctgatatattcattgtactaaaagaaagaaaggcacaaggaagattatgtcactgaatcctggtcttcattttagagcacaaatttaattttctgttattgccatatgcagggtcgttgaaacatacaaatacctacacataagggaacacatacatacaaagatattctcctacccaaactattgcagaaaagatctggctgctctttgctttaaaataaaaatccatttttaatgcaaatttgctggtttgccgttcaccaacatatgaattaacgaggttttcatcccctctctcttgaggtctggtactaaattactcaaactctccagagttaattggaaaccatgacctaaatgttcccaaagtattgctgattagttctcagaaaactcattcccatcttttgtcaccccagacaccacaggatgactttttaacatgtgcagtagcaacacactggcatgagaaatagattaatcctccaaagataaaccacagctttgaagctatctgtgtaaacttccttcactgatacagacattttattttttaaaaaaaatatacatatcacctagactttagatagtaagagagtataggcattatcaatcacgtaaggaattttgaaagacacatttcatctctcatttttttaaccttatgaatgtttttaaaatagagatttgcgaatttatcattagggaaacaaccataattatacactttccctaaaaccattagtactttcctgaaaagacctgcattaggagacagcagtagaaaatgtgttttctactttactttgcattacccgtttcatttgatttgtatttcaactcataaatcactgaaaaaaattagttgataaagaaatgtacacagtgttatgagcagatgaaatacacgtctctatacacacatatttttttctttcttgaatttttaaagagattgatactctttaagatctgcattttatatttttctgctgatacaatacgaaaaggtactatttggagaggttgaaatataatgttgggagtaatgaattacatttggtttggttaatatacagagactcaaaatatccttttgggcatttatacaactgtaagggatctttagaaaaaaatgcagttaacactacttcccagataattacacacttaaaattggtgttgacctatagttggacacatttctgttctaaataaattctcaatgatttgtataatgcgaatttttaagttggctttggttacttgcagtgataaactctttaaagatatatttcctaatgttgatagactaagcagcttttcttctctcctaaaaggatttgtttaaaatagtataaaaaccaatttaaaagatgagcctaagatcatctcttacaaacctgataagactgtgcagttatatatatcctcatccacaataacttagagaaaaacagaacaaaacaactaactgtagcttgttagttgttgatacataatattcagaagacagcaaagcaggcaggttcagttttctaatatcaaatggcaaacacacaacagattcactttaaaagaaagaagtggctaaaaacatatcaacagatgaaataaacttatagtagagtcctgtcagtggaatttggaaatacgaacaatttcataaccgctgatctaaattctgaattatgatatcgaaatatttgtgacttttattacctagtctcttactcagtactctcttgtggttaataatacacatttgaaagggcccttttagcaaagcacatgaacagacactttttaaaagaaaacatacatgcgaccaacaagcatatgaaaaaaagctcaacatcactgatcattggagaaatgcaaatcaaaaccacaaggagataccatcacataccagtcagaatggctatcactaaatagtcaaaaataacaggttctggagaaaaagcattgcttataaactgttggttatagtgtatgttatttcagtcattgtgaaaaccagtgtggagattcttcagagatcatggatggagctgcaggccattgtccttagcaaactaatgcaggaacagaaaaccaaatactgcatgttctcacttattagtgggagctaaatgatgagaacacatggacacagagaggaacaacagacgtggaagcctactggagtggggagggtgggaggagggagaggatcaagaaaaatatctaatgtgtactacgcttaatacctgggtaacaaaataatcggtacaacaaacccccatgacatgagtttacctatataacaaacctgcacacgtgctcctgaacttaaaataaaagttaagaaaaagccattttatattcaacatgtattgttatagtattttacactaaaataatgttctgcagttttcaagctcctttgacaggatccacagatagcacctcctttcatattttaaatagcttgatgaggctaatgaggcaggttgtaattatcatgaacagtttatagatgaggaacttaactttcagggaagctgggtgagttgccaaaataaatgacaaatcttgaaacaatctagtccactgtactataagacattacctctcaaggtagacttgccagtctccctgtgaagtaaatataatggatattaatatgtcactattctcaaaagccctttgttttctgttattattatatgaattaggattatggggtatgtgtgtatatatgtgtgaaaagagaaaagaaattattattcctttgcttaccatcttcatccgtcatctatgagatgtgttacaataaatactgaactttgaactcgaggtaagcttgaggatttgatttagaaagaaggcattacaggcattaatcgaatattttaattcttatgaaattatacaaagttatagtacatacaattttggccttctctaaatgataagttagtaaatgttggttaatgatacagagagtatctgaatgtctatgtattttgggatatcttttacataaaatttctaacatgaaaataaaatacttcatacattgctttactagacattttacagtgaaataaatacattttaataaaaccaactgaacgatgaattaatttgtcgaagtgacttagtttaagtagattctaaaagaattgcccttctaattgtaaacctattttaatggctcagatatgatttacaagacaagatgtgggattacaagtagcttgagctaattaaaacttatcaaaataaagatttaaagtttcttgctttcgtacttttaattaccagggtgaaaaattgcatttaaaagacctagatactttgaaatgtattgatggccttttataagatcaattaaaatttataaagaacagtcataatttaggatttatttttttcaattagaagtacaacatgaaaggaatgaatctgagggtgcatctggttttaagaatcctctgacttatgaatataccacttactatagtctggatattcatcatcgtcatcaccattcatcaaccacaacttactgtaaattatttgagggcaaagattcacaccacagttcctggcaatttaatagatactcaataaatttaattaaagtcaataaacctactaccgataaggtatacagcttctaaaaacaaggccataggctcttgttcttaaaaaacttaaaattttcttgatgtgaatttattgaataataatttatatttatatagaattttagagtttagacattgctttcacataaattatttcagttgaacctcataataatttgaaaatattatctttgttataaaaaactattgttcagttataaccaagatgtttaaaaatgagaatgagcaattctgtgcccaaaattgtgttttgctttgcaaatgtacagatattcaatctttggaatttgtatctttcatcaaattttatattagccatgaaagtgaaggggtggactattttactgggcaacacattgtatttagctgtcaatgactgagtttctgttactcttccacgaaagttaacaattttttttctgaattttcaaaatgagtgtctgcaaaaaatgttatttcaatactttctaggtgtattaaagaaatagacagcatacaaataataacttctgtcaaaattaacctgttattttggcaaatgttcagattgcctataagtttgatcctggtcttcagacatcaagtaccaaaagtgccttaaaacgcatcctgtccagacacccatttggcttctgtcacccaaaatactcctgccctccctgctttttatcacccataagtttgatgggcctcctctctgtagttctactcatgttctgtcaaaaacatccagtgtgtcagggttgagaacagaagcttgtgacatagcaccagagatcttccatcaccacctgacactggtctattaatcgacatcctttgcgtaaaatcatgaagtggcttctaagccatccaatttatcttgcatctagccagtatttctccaacttattcacaagagtataacgaaagactttgtcaaatgcccagatgaaatgcaaatagactgctgcattttacttacctacttgtctaaaagtttttcattgtaaaacattattttatctcaataatttagacaatagggatttatccctgtatgcaggtatatctgtgttgttttactaaattagctaatctcttcaataaatgggttcatatttctcttatagcctccacgtaagttgcatttagcattttaaatgtcttggacagctacaataatatctcttataatttttacataaaattcaactgcatttatcaacaactggttagggggcgattgatatagctatgtgaggggaaggagaatagatgagtgttatcaccacccttttatagagatcatgccattcaagtggtgaaaatagattataattgcagtgataatcacagaattgtaaaagactgggctagacaatctggcaggtctgaaatggtaatttcatttagtcttgtaaaaatggcaactgtatcactcagaaataggttaggtgctccgaaaatactgctatttcattaattcacaaatcagtatttgtctggaaagatatttaaccaaattatacagaccacaaaaaaaagaggcatcctagaaattgagggaggacatttgactatcacagtgattgaagagtgttactataatagcattctgtggagagggaatgaagatggtagacttcttatacaacaaagaactctcccaagtctgacagcactttggaatatcccactggacatgcatgtatgtggaaaccctgtttataaacacctaaacctggaacgtaactcaattttacacgtaaacataagatattttcctcatgattttaagacattgaatttttcagccatgcaactaactgccataacgatccaagaaaaaatttatttcatggtgttaggaattttgccaagagttgttcagcattttggaaaattacgctatggatgaccaatgcccctcatggtatttgagtctccatacaacacaatggtgtcattctgcatttgtttatactgcattgatagtctcgtgatctaaaaacttcacttgtgttccagtgtgatcctgcctgaataactgcatactacaacacatattattttattataaatgactcttatttctctttaaaatagagttacggcatcatttaaactattgcctgtataagtagggtatgttgtctacatattttggcttataatcgtaaagaaggtattacaaagtatttgttatttaaaaaagaaaagaggggtggcattgggtctgagaagtttgaaaaccaccgatacagagccactggggaatctcaagagaaagtttattatactgaaaattaatagaatttttcaggagagaatgaggatgtgtcccctccctgtgcatccaatctctgatccctagagctccatagagaatgaaatagcattttaaaaattgctctcttctacaaccagctgtgactatcggtgaaccggaggtctacttcatatacgaacctgaattaaaaacagccagcccttgagtcagttcagagcccacgttcttgattacatttgacacaataatcatcatcatatcttaagactcaaatcagcctgacagtgctcaactcagggctgcttctcccaattagctgaaaattgcagcccagctcatctcctagggaatacgtttacatttacaattttgctgtggcaaaaaggcaacaaacacgctggaaggagcaaatcagctttttaacttttacactaactattttaagtttacctaagtctggtaaacctgttttgacaagaatgacaacgaggaagctttttttgttatgattttttataactgcgcaaagtttaagataactagagtttggactagaaggggaaaacagatacacaatgtgaatatttttacaagttacttgtcaaatgaaagctttcagaagaaacagcctttctttggtaaacggtgcattaaaataatttgcaactaatagatagggacatgtaatttgaaaacaaaaagtgagtaaatgtcaaggtcctaggaaatattttccaattatatgctaacccgataactccatgtccatgtgacatagcgttattctgtgtaattctgtaaattacttctctcctatatttctgaggggtggaataaccaaggacatttttgtgcattttgtttcctcaattatgatacctttctatgcagatcagggcagtttgcacacactatgggaaaaatggaaagtgacaaggtaaccatgcttcatggtggctgtgctgaagatttgctcagataacagtgtccttatgcgctgtcttctaagcggatgacagtgcagacatggaagagaaatatgcagatgggaaaacatgaatctagaaaagtgggaaaaatactgaggagcaggagacctggaaaagtaagacaattctagagtgggctgagatagaagacatgttgtaaccactggggacaggaaaacatgtgaacaggaacatgtatataagctgacagtgtgcaagagctcacagaaagcaaatgctaacagtaatagagaaataccattgaggcagaggtagagataaaaagaaataaggagggatcggccatggtggctcacgcctgtaatcccagcactttgggaggccaaggtgggtggatcacgaggtcaggagttcaagaccagcctggccaagatggtgaaaccctgtctctactaaaaatacaaaaaaaattagcagggcgtggtggtgggtgcctgtaatcccagccactcgggaggctgagacagagaattgcttgaacccaggagggagaggttgcagtgagccaagatcgcaccactgcactacagcctgggcaagagagcgagactccgtctcaaaaaaaaaaaaaaaaaaaaaggaataaggagagaggcaaagttgaggacaggcgcactggggaaatgacagaaataacaactcagagaaaagtgagtaagtgcaacatctctttgagtcttgttattcccaaacatccctattcacccaaagattaacatttcctacaagacaccatgttatgaatatccttaactaatggatatccctcaagaagaaatatttatttttcttatagtacagttacatacatttgggaattagaatggatttttaattggtttctgatccaagttttaatcattttgcaggaaagaagccaggactcttacaacatatgaatactcatctattatgtataatatcatttaagtggattttgccccaaatctttgtggatgtgcataattgaagaaaaagataatgttattacttctcggtaaattaattgacggtttctcctttaagattggtcaacaatctgagtactatgagcaacacttcttctatagattctgttctcctttagaaaacaaaattcacgtcttctgttgtagaattaaatctttgacagttcttaatgttgagaaaaataaaaatatcctcacgaaagtcaacattctttaatattattgagaaaagagtatacattcacattttattaaaactacggtccactgctataagtgtcatgaagttaacatatacctagtaaagtttgtaaaaaataatcagaaataagctttagtgaaaaaatccacatgttgaattttgctgtttctcacattaccttaaagtgtttttccaaattctagcttagccaaatcataaggaaactgaaatagaaatcctttgagtgactactacatactttaaattatggatatcatgttgtaaaacatctggctcattcttgtgctgtcatgattttccaaaataaaacatttgctgtttagatgttgtcatttaaaaagacccttaatgattagtcaactgatttgctttagttgatttcaaagtatatgctaattgacaacattgatgatgacacaatacttaaaaatcccatacaagttgtccactgaacaatttggtcatttccttattcatttccttattaatgctcacagaagcatagttatcattttttttttagtgagtcacagaatgggaattaatttattttaatccaatgttccgttttccttattttgctctatcagttttgtgagcccaaagaaataaagttgaccacagcaaaagcagtgctggggaagaggccagtttataggataactgcaataccttttacttggaaatatgtttgaagatcacctgaaagtttaattgacacaggatgggacagcacatctaggaaaaatggatgccattcagacaatcgttcttccgattttgatctgactatctgttcgctttgcggtgtatatcaaattgttgaattaaatttcaaaaacatcacaggtctacagggaatcattagttcccccaagtactttcgagagttgactgtagctcttttacttccctgctgtaatgacaggaaacgtggtctgaatttattgctatctcccacctctcttagagaccattgttcatttcactcatccattttccttcctgaataaatgtcaataggaaaaattggttttgataaactatattttatagtttgataaactatatatgctttctttttcaccttcttattgacaacatttgtccgattatattagcaggttccaggactaagtttaacaattattgttaagagtttttgtagggaaaaatggtatttcttgtagatatattagtagttgataatttatgtaaaaatttagtgtttgtgataggcacttttttaaaacttttcatttgaaaatatgaacatcatccatttccccatctaatcatgtctttcctgaagcatatatttttaaagtagctcttaaaacttgcaacatgtgatgtagctataattattttaatctgcatgaaaaataataggataaaaattaaagtatcagtgtaattttgatgttagaactaataacattgcacatttgttttgttagtgaaatatgtgctcaaatgatataagaataatattaggtaaatatggaaaagtagttctatgaagaatacattttttaaaaatcttagttcatcaatgcagtgaaagcaaatacagaattctctagattctcccattaaattataacagtattcagaattctttcaatatatggtggaagaagcaaaagctgatattaatagaatattatgccttttctcagaaaaacattatactttcatagaatgtggactcatatatatgtatatggagaattttgttcaatgtgctcaatatctattgcagtatctggcaaagagtgagtgcttaatttttactgaagcacttaattagaaaatggcaaatatatgtcagtatcagtattttcaccatagatactttcattatatagtaatcacagtagtgcatatataactgccactgtctgattctgacttgtactttcaaagttagaataataaagctctgccaggtaacccattttcaaaagcaaactttggcaaaactttggaatacaaaaaagaagatggagagaaacttgcctttccaggaagaatggcaaagatgtggtgagatgccctcttagagccagtatgttaatacgctaataaaagtagaaaagacttactagaactatttgaaatatcaaaaagtaacacatcactgtatgtgagaaaattctcaaaaagttacagaacctaacatcatataggtgatgctgcaatgtaaaaacacacacacacacagaaaaaggagactgatagcaaatacaagaatttctgtgtcagaattaacacaaactggtgttttgagcttaggaaagtcacagactctctgtgcctcagtatccttttctctgtcataaatattttgatattgaaattggtgacttcataggttaactcagacctatagaatgtcacgttcatttagaatatgggacagcaaattgtaaagatgtctgtccacctgctactcatttggcaaacagtgcatatcccagggagcagaacccagcgcaagcaagctgtcctaccattatcaattaagggcttgaagtcaagaatgagtcccaagccactggtttgccaaggagtctgcaaaatcttgctagaactttgactttcaattctggttcttgcaactgcactattaaagaaccttggcctcttcttagagtagaccaggtccgtccaccaggaatagttgctaagagttatgggttggccagggttactctacatgagaagtgtatgggggtttactcacacacaccaagtgcttggctgggcttctggaattgcctacctgtcaggataagttttactgttaccagcagcaacctagcaactaggctaaaagtaatcactagcgtggtgtggtttataggttttgtgtgggaaaaaaatcctcaaaattatgagttacttccattctattagaatgttgatgaagacagagtgtcaaggagggttaatggcatttgtttcagggaaaagaaaaacgttattagcagatcccagcaattttaatagactctattgtctattgcctctattgttgattgccatctgctaaaatagagactttattaagtatagcttcttttactgaagatatccctgattacttcggtggatttctaaaaaatttctcctccatcctccttgtgggaagtctcaggaaaaaaaaagattcaatatgattcaaataggctctgccagagaatcaatctctatcctctctctgtctctagctagctagctaattaatcaatattcccagaaaaaagtccttaaacttctaccagaatatgaggtaagaataacagccttggaggagtcatagaaaaaaatgtctgaatagagtcaaaattcacgtaacacaaattcccttggttagcatggcaaatgtataggcttatgcctacgtgaagaattgagctaatggcactagagaatactattcaggtaactcacggtgagatgatttcccttcagtggcctggcctatatgctatgctatctatcttacaaacacttactgagtgcatgttctatgcatagtattggaccagatactgtagtgttgtataagattcttgagaaattgttttcatggtcaaacttttagaagggatgcatactgtatagattatcccttccccccatactttcataaatacacatactttgttgattcaccaagcatgcactgtaataagggtctgattactcctatgggaaagaagtctgttcgctttgatttaacttgatattacctaatcattttttcatccatagaaccctttcttgagttattacttattaagatacagtggaactagttctgccaaaaccccatttggaaaaagaaaactcccactctagatgatgagtatgtgaagatcaggatgttataccatacaaccaccaaggtatcaccaacctgttcctgaatacttctacaactttacaaggcagcctgttccatctttggacagctttataacaatattcctctctctattaagctgaaatatacgttcttaggactaggttatatgcttaaatttattcggcctaagatcccctttggctttcctttcccactgttctatcacattgtgtgttgtgtgttgtgtgtgtgtgtgtgtgtgtgtgtgtgtaaagagagaagtgaaacagaaggagattattgttgctaaaaactctatgttatctccatatttggaatgtttttggttggtgtaggcagtggttctcaaattttaatatgcatagaaataacttggaggcctgaaagcttgttaaaagttccccaagtcccatccccagagattctgatttagttggatggggtaggacctacaaatttaaatttctagtgagctcataggtgataccaatgctgccagtcagaggaccatactttgggtaacactgcggtcttgggtacactgttgctctgccaagacctcatgccctagctggttggaatattgactactaacagctcacagctgcctccctccctggaaattgccttcagctgtaggtaacaatcttactccagtctgctctttcccatggggtgacccaggaccattaactctctagtattgggttcaaaggtccagatcccttgcttcaattcagcgtgtctctaaagggccatgcaatttccagaactcccctgaaaatctgatgaggccgcaacgcactgcaggcttcactgcacttcttcgtctgtgcaatcttgcctatcttacaaccttacacatgtatctcatgggaacactcctcaacaaaccttatgcacacaactctctatcttagtctatttccagggagcccagtctaagttagatgggttttttgtttcatgtttcttttgaacccacatgtagcaccttgcatttacattacatctttcagtattcagcctaccagtccaacttgttgaaaactttttggctcctgatactcttgtctgctatatttgctatttctccctgctttgtggcattgatttgataagaatgttatctatgtcttcatccaagccactgatgaaaatattgaaaaggacagagctgagattagattaccgggaatagctgcctgaaacctccttccaaattgataggtatccattagacagcagtgaagggagcataggcctcagagttgcagatttgggatggaacaacagttccgtttaagcagaggtcaaaagctagactcacagctaaagagaacaatgccattttagcatttctattttaataggaaacttaagtatcacttatataacacatttcaacaaaacatatctcactataaaaacataaaatcataaataatcattatgaatttatgattattattcatctaatttgtcccagcatgaaaactgtatttggtcatttcatggagggttttttcgtttacacattttaaaaaagaggttgtgataaagttgaagttcaacagctaccccaacttcactaggacatttaaaatactggcaatataaaagaaaaaggcaatccatcagtaattgtatgagcggccataagtttaagcaacgtaggttattatctacaaaggtgattgaatttggttcacctgatttgctttaattgctctgtggcataaacacactgactggacacagagtgatgtaatgagtatcataattaggaatttgataaagctaagtgtgaaactgactattagaagatatttgaaacacacaactactgctttgaatggggaattgatttcctagttaatttaaataattttcatctctttctatgaatactgatgacagacggaatgaccacagcataaaacattggctggaagaatgtcactatgtacttcaagaaattatttcccccatgttttttattgaaaagataaacacctgtccatttccttcctaataaaaatgtggtaagatttttttaaatgaaaaaataaaactatctgaaaatgcttttaactgttaataaacagggagtaagtaaaataaaaataggcaaaaatatatttgcaaaaatatgatagaaggaattgctaagaatgttgagaatgattctttatttgtaaatttttgatagtttctacaataagaatcacttgtactaaaggaaagaagttatttcaaaatatagaagaaacatccaaacacagaaaaatggtagataaaataccaaaatagaaaatcaaaaaggcacaatctgggcttagaaacaagttaagtagctctgtgtttcagaaatgccacaaaaacacacagtggtgcacggggctgcagacatagggcttttggggcctgggctgggaagtaggtagcagtagccaggagttcagattctgctgggctcaagaatctataaacactcggtataagacaaaggacctgagccaggctctttgctgcaattagtcaaggatgatatcaggtttccctacggggtgaaagggagctgcaaaaaaaaaaaaaaaaaaaaaaaaaaaaaaaaaaaaaaaaaaaaaaatctgctattgatcacaacctagaactgattaaatgacatccctttttagggggaaattggaaagattagatttcataaaactcattaatacctatatgtccaaacatttttaatataagaaatcatttgaattaatgatttagagaaaggaaacagatccctgttacatactgaataaagccaaaggatcccaaaactataagatttctagaattgtgcagaaaaaaattaagtcaagtgatgattatattcatttattaaaaaaactcaactttctaaaaataaatctacctaaattctatttttattgaatgttttaaagaagtctttctgagaatgatacagatagaaataaaatgaaaatataaatataattgaaaagtaacatgatgggtattgtagctaacattaatggttcaattaaaccaaataagaaaaactttctcccatttgctttaatatttgatactgtaatattaaatttatgaacaaaaaacagtctgttggtatcctataattttttattaggaaacaatggtaagttttcgataatactattgtttttcctgggaaaactgatacataggagcatttctaagcatatattttggtgcgttggttcagcccagttcaggactgtaggactgggttagaatgaaaatggctacttggctacatcaccaggtaattttccacaccagtaaatcaccaatgacatggttccaaatgtctccctttgtgtgcaatccctgcaagctagaaacattctaattacttgaaaggagatgacataaaatgaagcaggctgttaccactatgaaccttttagatccatatggatcatgacactctctggcccggagccccaagatttcacatcatagatgttatattaccctactgtagaatgcagagaatttttttttttttttgagacaaagtcttgctctgtcgcccaggctgtagtgcagtggcacaatctcagctcacttaaacctccgaagagttcttatgcttcataatcagttgggaagatttgggtctcagcaatataaaaatgggattgtcttgtaactatacatatgactctctcctgaagagccgaaagacacattttcatactgctaagtgtacctaaaggagttgataatggattgaattttttaacataccaaatcctctcagtccttaaaatggactacaaggtacatttcgcataagaggaatttaaaatagggtattcaaaattgagagggttgaactggtggctttggggtcatttgtagctttaaatttaatttaattttaagagatggagtctcactacgtcacccaggctggagtacactggcatgatcatagctcactgcagccttgaactgaactcctaggttcaagaaatcctcttgcctcagcttcccaagtagctgggactacaaacttggcttttttttttttttttttatgttttgtagaaatggtatctcactatgttgcccaggctggtctcaaactcttggcctctagtgatcctcccacccccacctcggcctcccaaagtgctgggattatggggacatgtcccaccaggaactttaatattttaaataaaatgtgccacatatatattatgagcaggccccaatgtaataaaggttgtattttaaacaaatatcccgctagcattctatcatatttttgtacatagctttgaaggcagcaaatctttatcctttaaatttttggaaataatccaaagccattcagtgcccaacatctgatgaattgtttcattcaattacaaacaattattgagtacaattactcagcaaataaaaggtatggctataaaataatataacagtctgctgaggatcataaaacagtccttaagtagttccagaaaaggaactctaaaattatattgccaagggacggtatttgtagatacagcatataagactcttatgaagttctaatgcttgtccctctcctaaataaacaaacaaatgaacaagcaaaaatgtataacactatttgcttttcttcccaggaaaatgttttactttttcatttgtttttactttcagaaaaatttgagaatgcttttggaaacatgtcatacatgtaaatatcatgcatcaagtctcaggagggtaaaaaaaaagcactggaatcaaagggaagcaagaagattcatttcaaggaagacagatccaaggctgttgtgaatgtcaaatgagcgtaaagacttgataactggcagaatagagaaaagttggttacaatctcccagaaatctacaaaggatgaagaggctttaggatgaggtgacaatagggataaagagagggaattgtttctagagcaatttttgaagtagaattcacagaatttggaagccagtttaatacatgtgtcagtagattgggaaagagagatcaagagaaaggtagaaggtaattcttaggtttccagttttagagacaattaagttagacaattacactacactgaaaacacagaaaatttaactttcttttaggggcaagataatgcattctacttgacacattttgcagcctgtagcatatccaggtggtaatgtaggttaggtggcagaaagtacagttctggagatcaggagaagagtgtaagatggaagttgacactgaggagtcttaatgttaactgaagccaacagacaaagctactcaaaatgtgcagagagaaagaagagagacaattaagaatggaacatcaacatttaaaattgcattgaagacagagaacttgcactgatcattgttacaactcccaactttgtatcttgagctactccccataacttaagattcatatatccagctatctactccacacatctcctagatgtataataggcatttcaaatgtaacatatccacatcttcctcccaaaatatgttactcctggagccttccccatctcagtaaatgatgaccccatctttccgttgctcaggctaaaaattcttgagtcttcttgactctttctctcacacctaaatttattccattataaaatctgttgtgctctgtacccaaaatatagtagaatccaaccactcctcaccacattcacctctcccattctgatcccagccacagtcatctcttgactgaattatgacaacagtttcctaatggtctcactacttctgtttagtctattgtaacagaggagccagataagacaaaacatgtcactcctccattcaaaaccctccaataactcccatctcattcagattaaaagctaaagtccacaggcctaaaaggccaatataatcagatgccagttacccctctaaatttattgtcaactaccttcctgctcgcttgatccttttctgcctaactgatctcccttttaaggttccttcaacatgccaagaatattcctgctttggggcattttaacttattaggactctcctggactactttttcccccccaattatacatatggcccacatcctcaggtcttttagaatttgcttaaatgccaccttttcagtaagaccttttttgattaccacattttcatggcagcactcctcttccacctccctctctctctccacttgttttcctctttgttcttccacactgtgtgtatgaccatctgacacatcatgtatttaatttttatttgtcaatgtctgtcttccaacttctgcttccaagaatataagctttatgagggtagggcttttcattgctctataccaagtaccaattactgggcctacctagcacaaacttcatacaaaagtatttgttgagtaagtaaattaatttttatggtgtcgatggcagatgatattttactgagttcttactacgcactaggcattgtgccaagcacctcacaattattatatgattagagaaatgagatattcaagataatattgttctgggaaccaaggaggataaagttttgattagcagagttgaccaacaggatcaatgttaaaatatagtcaagaagatggacgaattaaaatacactaattagctattacaaagtcactgatgatcttagtaagtccttgttttcataaagtggtggtgctggggaagtgagactggagtgggtcaaagtacaactagtagctaaagaacaggaaacagtaatgccaactactgcttaaaaatgatatagtaagcagaagcaagtacagctggatagaaaaaaaatgatatactaaaaaagttctcttaggatgagggagacttgagtatgttggcctgctaaaggggaggagcaaaaagaaagaagaaattgaatatcccaaaaaaaggaaagtagaataattactaaaacaacatgttggagaatgtaaaagagatctagtgtttaactagagtagctccttgctacacacaaaatagggctcaattgttttctcttttcttgttgcaatgaagatgagaaaggacctaggaatagagaagcaaagagtgacttacaagtgccttcaaggttgtcaaagacggagaaaacaggtcaaaatgttttcagatgatcaactattaattttgatcattaaaatacaaaacagtattataaagaacagagaatactgagatgttatggaagaaaatgtgtttgtatgtatatgcatgcatatgcatatacacgtatatgtatatatgtacacacatacatgtacacacatgtacatgctgaatctttcttagaacctagagggattttttagtatctgggagcttagctaaggaacttctaggcatgtttaaccctctgatgcaaggaccatctcctctgcttgatgagtttgtacctggctagttggcagttgtggaagccctcatacagctacaagcagacaattcagagttaatgcttatttcttgtttaaagagtgatcctggaacagaaataaggaaatgaaatctcatgacagtgtcatcataaagtcatcagccagatggcagtccttgaaatctaatccttagaggcttctcacaataatttgtaatatcacatctaatattatcttattcacaaactcatatctattcacagagattgaagacaaagaaatgaacttgcagaggctcacatttctggctttatatgttatcatggactctgtaaggactacgataaggaaaacaacatattttcctacataggtcacaacaataatctatgttcagatctgggtttctaaactgtacaatttagttgagaagcagccttctcttttttccatagatagattagttccttttaagcataaatgcctatttatatttattctatataaaatggcaagtaaaaatgatcatatcaaaagccactgtagaatttgaagactcatctgatgtattaataaacttaaacagcaaaatataaacattagtttacttttttattatgtcttgaaactgcaacatggcagtgtctgatatcaaagcaaatttctttcaagtacattttatatcttatttaacattcaacagtttaaaactaaagattttattactaatttaaatattcttccaagtgtacaaaaattttgcctaggtttctccatgtgactgaaagtctcagtgcaggcaatgcattagtgtttcatagtaaaatggtgtctaacctgaactgtgagaaatgatgtaatcagaaaactttccacagaatccctcctacctaaaaagctatagttacagaactttttcaaagatatgagatactttttctccataacccaaatattgacattattaatctttcctttttaagatgagtttaatataacaacaaaagtgaaaatgccatcctgtcatagttgtagtttttgagaccaacacaaataccatggaatactacgtagccataaaaaaagaatgagatcatgtcctttgcagggacatagatggatctggaggccattgtccttatcaaactaatacaggaacaaaaaaccaaataccccatgttctcatttataagtgggagctaaatgatgagaacacatggacacgtagaggggaacaacacatgctagggactattagagtgtggagggtgggaggagcgagaggatcaggaaagtcaactaacgggtaccaggattaatacctaggtgatgaaataatctgtacaacagacccccatgacacaagtttacctatgtaacaaacctgcacatgtacccctgaacttaaaagtgaaaaaataaaaataaaaataaaaaagaaaatgtataaatagaaaaaatcaggcagaaacaagtaaatgcattacaacaagccactgtgtagagacaacactttttatttataaatagaggcaataagatttttgaagtagcacagtaaataattattataaatgtaccctaaactgcttaacccatttatgcctaaggttgcaattttttgaatttttgcaatcagaccttggtgaggaccttgaacagtagaatataaataattcccacatgcttagtattccaataatggaacactaggataaatagctaaagtgaacatagacaaagatgatctagagcaggactatcagtaaaactttctgtgattggtggttacctgatgctgggaagggtagggggtgaggggatgaacttgattcgattttgcaggctcagagatggaagggaatttgcctcacgatgaattgtgccttgagtctcacccatatctaatttatattagattgcacttttgagtttatgctgaaataagatttttggggctttggggatgaaatgaatgtattttgtctttgagaagaacaagaattttggggaaaagggggcagaatgctatggtttaatgtttttcccttcccaaacttatggtaaaatttaattgccattgcaacagtagtaaatgtgaccttgaagaggtgattaggacatgaaggctctgccttcatgaacggattagcatcattattgtgggagtgagtttcatataaggacaagtttggccccattttttctctcttttggtcttccaccttccatcatggaatcatgacacaacaagaaggcccttaccagattccagccccttgatcttggacttcgcagcctccagaactatgagccaacaaatccctgttcattataaattacccagtctgtggtattttgttacggaagcacgaaaaggactaagacaaggacaacagaagtaggttgcatttggagaaagagattggaagaaggcaaagatgagtttagctttggacctcttcaatgtgaagttcctgtgggacattaacatcgaaagaaagcagcaggatctacatgtctaaaactcaaaagatcattctcagctggaattatagatgggtagtcatcaacagactgaaactacacaagtggatgaattcttgcaaagagtacatgtgaagtgagaaaagaacagggaagaactttatagacatgagtcagaagtagcttggtgaattgcagattctgtacaggctaaaaatgtgagttggcttctaaaattctcatttactttacccataggggaagtaagtatatgcattccttagctgatagctttttggaaccaagccaaaaaatataaactggaagtcattcccatgaagaatccagagaccttgataaaacaattttttaaaaaactgagagagtggcttgggccatcaaggagcatgagaatgaagagaggggtctgtcagaaagagtagtatagatagactagatcagtgtcctcaagctctagtttcataccatgagcaagcttttttcttggccccttagtttatattacctaaactcatcaaattaatctctgactttaatttgctttccccaaaagacttctctttgagaagcagatatttcccactaagatctaatggttgactctctgataccaattgattccatgtgaataattcttcctgaacctaatctgtccctgtttaattgaacacatataagatctgtattttgagaagaaagtccaagccttgccattgagaaaaagtagttactatgagaatttttccaaatatcagctccatattcaagtttgccctttctccaccagggtctttttcatagggctccaattaaaacttcccaactttaggttgaatcttcttttccatggtcttttccatctatacacctactgtctggaattcaggattagagttgctctattccccagggtgaccagcttaaattcagcttcacaggagtttttactctctaatgtctagctcagtttcaaaatttagttggccgcttaatttccatatatcattatctcatttctcctaagacttcctactcttagttcaaaatctgttttggccccagtggtgacttttacttcttgttaaaaatcaccgagcttattttttcagtaattgatgtcatattttggaactcaattatttttcaccgtggtcttcctcatattgtacaggtgctattttttcagcttgcacaaggtaattgtacattctgcaaagggagtcatcattcaaaaaacatttactagctccctattatatcacgtggttcaggacctggggatgtatcaaatgagaaagacaaaatctctgccctcatggcatttagattaatttaaaggacaaatatttaacaattagttacataatttatatttttatttatgattggaataaatgctagtgaaaaaagcactagagatcaagagaggtataataaggatacaaggcttagtttgaggagatactgtctataagcgctgttaatttccattcatatataatgggaaatgaagtgacgagtcatattgccctccacaaattttcccattgggtgtgtggagtgagatactaggatgagaccatgtacagctataactctatcatgaatcccaaagtgacttatttatcagataacaggtaaggcagtgtgcgccatgatgagatagaaagatattcctttggatagagttatcaaagtagactgataaatggctcttctagctataaatcagtattttgctttttgtttaatctcttggttatgtcactacttttgtgacagcgggcaaatgagatcttatgttcctcgtttttaaaatagaagtctgagccaagtccgtgagtttagttggtatttatcgtcttgaaccctcccaagctccagtttagctggattggaaaaacaaatcctcatggtccatccagtttcaccaccccattattacagccaacagtagttttagaaataatgtaattcataccttttatgaatgcttctccaagaggcattgatattctctgttatcatgtggacttttctggtatcatctgcagaataatcccggagaagtttcagggccaagtcatttgccacatctacatttgtctgccactggcggaggtctttggccaactgctatagatttttatgagaaagagaatgaatgtcagttttttttatgaaatctctagttggagtgtcttaaaatacttcgtaaacagcttctgaatcctcaggtcagaatacatatattagattgcttttaacctaccatatgatttagtcaatcatgacagtataaggtaacccacctttcaggacaaacttttcaaatgcagcatcttgagcaataaccagtatcaagtatttcaacttagtagcaattaattggcaataaagtgggcttaattgtttttatcacaagagaaaaaaactacaaaaataagctcatatataattgttgaatatgtgacatataacaacatttgaacgaaaaaaacctcatacatttctttccctcttcattaacttgttgaattgtttatgtaattagtgccatctactggcgttcaactaaacctgcatacagaaaatattgaacaacaaaagaatagtactgttattctagtcacgaattttttgaaggatcaaaatacttttagaataccttactttaaaattagaaaaaaagtcaaaatataagaatcttactaaaccaaatcacctacattttcttcgttgtttgtctttggcaattcagtgttttcaaacttgctatctcatcacttgaaacatatttcaaagaaagaagtcaattaatggtaggttttatctcgaagcatatcaacctgaaatttctattaaacatttctgcaagtgcagagaggaggcttctaagcattaagataatactaattgttaagatagttatatcaaattcaataggatgggttaagtcattgataaatggacacaggaataggaacaggtagttcaaacaagagaaagagtgggatgattttatttaaaaagaaaaaagttaactttcaagtaataaaaaatagagtattaaattgaaaaggtacaattggacaccaattaaattaacaaaaaataaaatccaaagctgaaaagaccagtaaaactagcacattcacgtattactgctggggaccgttatctattaggacaatttggcaatagataccaagtgacatacaaatgcttattcccattgactcaataatctcacttttggtactttatcctgataaaatcttcaaaagaagatcaatatactatatgacttaaaatcttcattaaccaaagcagtaaaaaaatgagaaacaggccgggtgcggtggctcatgcctgtaatcccagcacttagggaggccaaggcgggtggatcacgaggtcaggagttcaagaccagtctggccaagatggtgaaacaccgtctctactaaaaatataaaaattagccgggtgtgctggtaggctcctgtaatcccagctactcgggaggctgaggcagagaattgcttgaacccaggagatggaagttgcagtgagccaagatcacgccactgcactccagcctgggcgacagagtgagactccatctcggaaaaaaaaaaaaaaaaaaaaaaaaaaaaagagaaacaatgtcgatgtttaatgcagggacattaaaagaacataatacatcattccaatggtccaatatgtagcaaatgtgcacagtaatcactgtaaaaagagcacaattttcttgtgtaaaaaacagaacacaatttttaactacactgtgtttatctctaagaatacataatcatgagctgaacacgaaatggaagaaattgaaaataatgcttctgaggagaaaaatcatttttgttttaatatttgttcttttgcgttagtatgatatttacagaataaaaatcaaacagtgttcttagcataatttcagcgtgtttggtgaactcctattgaacatatacaatctatatataatgtaatttctcagttaactaaaacatcctagaatcaaaccaagtaatagtatttactgcatatagcaaatagacccagattaccaaactattatcaagaagctaatgccaatatcactgacttttgctatgaaagcagaggacagtgtctaaaggcacagagcatagttgctgctattacaaaacaattaacatttatccgcgtggaatgcctgccttttcttccatactccttttatcaagcattacagtttctattctccacttttcagatcctcgcactatttgaaagcccttctgagggaacttctgccaaaggcttgccttttctagaaatatcctagggtacaaaattaccacttctttctttctcctcctcacttaagccaaacctaaagtgataaaagaaatgtattccaagatacgaaagaacatgtaattggcccttagtatccagagggtgctatttgcattttaaaagaagagcttattatctctcatctattaaattgctaattaatagcatgaacatccacaaaactgagaccaataacttggttacctttttttcaaatgaattccttttataaaacactgaattgttaataaaatacttatgatggaccagtatcagagcatatatgtaaaagctcaggaatacaaaataaaaacaaaatttttagtaaatatataattaaaatcatttattttactcaagcaagttaaataaccttggaagccacccatcactcataggttcctgtttgaaaagtctagatataagaggttataccatttggatggtttcatgggtatatgcacatgttctagcccatataattttatgcagtttttgtatatcaattacacttcaataaagctgttaaaattaaaaaacataaaatgcagaaggtgccaatgaatctaaaaacataatcaatagatcataaaaatgcctaaaattataaattataacatatcctagaattttccaaaatctctgaaagaaatagtaagctagagttaaatgacagatttcctactaaacaaggtagtaaagagtgaggcttgacgtcaaaccagaactttttgatgtactttaatgcttgaaaggtagaaatacgcgtgccatatatttttctgcaaaattgtattcacagcgaaagttaggactgttatacctaaggaaatcttgactgagtgctaaccctcactgaatactgcccaggttttgtgaggatgtaggattaaaaagtaaaactcccactgaccttgactgacattgagggggctcaggcccttatataaacacaaaggttctcaaaggtagccttttttttttttctcccttcttaaagacattccccacacagaatgttttccctttctcctacggtaatattctgcccgcccaccttgggttttacccaagtgtcattcacactaggaaccatgaccttgaccagctttgcctactgctgtgaaatttactactgggataactccagacctcagaaggagtgtaaattcaaaaatacaacagacttcacacacacccttttctctttctgaattccattgacaatggtgtacaccacagggaattgcttgtgtggtgatcatggtgtgtgaagaaatttaaaatactgtgagcactagcttataaaaaaagattgcctttgtatatgtgtgtgtgtgtatgtgtgtgtgtgtgtatgtgtgtgtgttttctatgaagaatataaaatgctaaatccccaaaagattgtttccccaaccaggaaagaaatgtttcacattcaaacccattatgctgctactgcactatgtgcttgatatatattcacagtatcttaggtagaaaaagtgattgtggactatgagacaacctgaattaatttcaagaattttgagtatttttttctactttaattgtttgtcttctctcatttcttttatgtgtaagaacttattttagtgatattgaccctacatggtagaaaagagaggaggaagagaaagagtagctaaaagcctgagcaatacaatgagcctgctgggtttgaatcctggcgtgatcgcttagtggcaaatgggagagttaattatcttttctgtgcctcagtttcctcctttgctaaatgggaatattaacagtatttatgtggaaatatgattaggtgggttaacttagagaattcagggagaacatttacaaaggtgcctggcgtgcccgaaggattaaataaatattaatcatcatcagcatcagcatcatcatcatcattactactgctagcacatctactactaattttaatgagtcaaactatattccccacagtgtgagccccttctgaatgcaaagcaagtagctcgctgttttatggacattgtctagaaatgctgcaactctaaaattctccctttaacttggaagataaaagcaagtgcatagctctatcattaaaattttaaggttgaatattggttaaatttccttttaaaatgtgttttgtgatattcacctacaagtaaaataaatgtttgttccgggtgaactattacttaaatttttaatgactgtgtctcaaaggaacttcaagaaaggcagtgcagagtaacgaaaggacatcttcccaggaagttttgcttgtccattgttctgcagtttgatcttaaggaagtcattaaccttgtaagtcccagttttgtcatctgtaaactaggatggggttacttgctctgaccatgcctccggcttgtcctgaagtgtcaaaatcaagcaattgctcggaaaattgtaaaacaggatcctaatatgcttatgaacaaaaagttctacatgttggatttgttatttttccttggatcctgtatttacattcatgaaccaagggattcatggaaaaatttaactctgttagctaaccaccaagaggtcgtttgctcttagatccattctctacccatttcctactccactcagtattgagatgtactaactcccataggaggtcagaatttcctgggatttcttgctagctggcttctaactaggttaagtcatgagacacactagtgggagacagaagagcatgagaaagggtgaaacaagataattatcccccttctctctctgtcttggcagtatctcctttgtctccgtttcccactggacggctgctccctctgtaattccattacctgctgtgcagaccttacattgggtgaattagcacccgatggttctggtttctgggctttggtaaaacttgtcggttccccagcccttgaggtggtaatagtttcctgaagttgctaaactctgggttgcctcactgtcctctgttgggtttgtcagctccttcattcctatggaggagccagtcctctgtattgaatttcctctgtttgaaatatcgaatgtggtttacagactaattcctgacaacacgaactgaaagaaatctcacagtaaatgatcctacctacaattccacagggggaaatttaatatatcaaacatacatttcatgaaatatcagactttacatcttgcatccttctctctagtctcagaggaagaggcgacttttctgctattggaagttgatttcaccatctgggcacccatctattctgggatcctcctccacatactccctctctctttgtgtgttccaacttcttgcctctctgcggggaccttctctagagacttcaaacatgagtgtctctctcatctttaaacaacaacaacaacaataatctgcactctatcattttctttcctttcacagtcacactctttagaaggcagatattcactcattatctcaacttgactacattcgtgccactctccaattcatgaaaatcaggcttctgccatcatcgttccactaaaactattctgacagaagtcactatggcaaattgaattactggccccaattctttacctctccctgtatccatgccctttgctaagtaactctgaaattcttcctacgaaagacagcatgcccttgacattgagcttggtcatgcgccttgctttgcctaatcccagtgggatattactagaagtaacacaagcagaggcttgaaatgtatttatgcagtgtggctatcccttttgcacttcaccattaccttaagacaaacatgctctggactagcctactcatctcaggaggagaatgagtgacatatggagcagagcgaccccaatcaacctgcaacatgaagaagtgccaccccacccaagctgaaaattcatgaaaggcaatatgggcttattgctatatgccactcacatttgtgaaaatagttaactgattcagttaccaaaagccaatgcctatggaaagatttaagttcttatttacttgatttatttgcagcaactggtgctgctgactattctcttctcgaagttctctgctttcttggcttccactcttttggtcgcctctgtattctctgagtgttcaagcttttttttttttttttttgcctgtcctttaaatattaatgttctccaaaattctgtctctggatcaatctgatatgttggtcctcaactggagcaggaggcagggaacatactccctgggtagttgtatcataagtttttttttttttttttttaacttttatccaaatcttctacttccattgacactaccttaatttacgtccctatcatctcttgctcaggtactaaaataatcttttttattggctccctccctccactctcaaaccacccttccacctacatacaactgcgtaaatgatctttttgtaatgcaaatagaacctcatttctcctctgtgtaaaacctttcaatggtttgctattacctgcaagacaaagtcctaacctctctctttggattacaaggccctcgaatatatgacccctacctacatattcactttcatcttttgatatcttcttcctttttgagcaattccataattgtccacatgagaatataaatgctctgaaaggttaagtgacttgttcaaggtgacatagctagtcagtgaaagagtcatcataaaaatgcaggtttctggactctcaattcaggtttcatttcaattcagttaaagaagttatgcatccatataaagaaatttaaggaaaaggactgggtttattttaactgagctttgaagaatataaaacaatcttgatgattatagcatgactggaaaattattatgtataataaagtaaggcatttctgaaaaaaagacagcagaaaaatacatagtttatttttgaaaatcactaaacaatttggtcccaagaatgaattaatgttctataaatccttattgggaaaagagaagcacaatttcttccctccttgtgtgaattaaaacgacctataaaacctctttatggatttataatagaaatgttaaaatagctgtaagaaagccatttcaaaagtaaagcctctcaccattaacttcaagactcatctattaaacctctgacattaccaaacaactctgtttcagaaggtaacactctatacagggcatactatttaagaaaatggccctcattttccggcttactgaaaatgattaatctttacaatagctttgaagactacataccaacgtcgttacttttctgtcctttcaacaatgactacaagctgagagcagactagtaaatgtgttatcggccaacccattagagttccattattttctgtcttacatggcttcatgtaatgaatttttataattaaactaatggcatacaatatatttttcccctctttactttcaggccccatttctcttccagctgctttggaataagtttcatacaaaaagaagggaggagaggtctccaagtgcttcgttaccttaatttcattatgacatttttgaaagcattctctttatctgggctctctctttaatttgctgactttattaaaaggcttaagcaatactgtaattaacaaatcacccagctaccccaggcatctgagaaaagtcagttgagagggtgtagaaatggatgggtggaaacgattccagaaacaatgccagaggacagaaccccagaaaatggcgttttttcagctccttttcagaccccatgagcatattgtggtagactgcattattgttctcaaatatccagtgccttttcacgccagaagattatacatcggcattcccattgaactcaggaatggccatgtgactggttttgtctactggtcacttccaggcagaaggctcaagaaccatgttccttgcctctatgatcatgaaagaatgtaccaagatggagataccatcagccatggtccccgagtgactaagctaagtagaatgctctcatcagtctacaacgaacatgtaacatgagtaaaatatagactattaagcctctagatttgaggttgcttattactgtagcttagcctatgctgactgacatacctattcagatatgaccttatttcacatagagtagggcaattctaatacctccagacagtcctggaccaggaccagggctagaataaactagtataatgacacataaagaacaggttctcttattaataaataggaagccacataaatgttgaggaaatgtttagaacaacaatatccctgtttttctgaactacaggtaacatctcagaatatattctataggacagaacctgcctatcttgaccataaaagaaaatagctccctatccattgtgtgatggaggctcccatctaggtagcagttatgttccacagacatggctattttttcatttctatagctggcaagcagcttcatgaaagagaaaaatggagactatgtttctaaaactgtgttcataaaacttgaaaaaataagaaaagatctgtagtcaatgacatgcagatatactttttaacataccataaaattctcccacttaaagtgcataattttctggttcttaatgtattcagggttgtgcaaccattattatgatctaatttgagaacattttatttgcccccaatgaaacccataccaattaacagtccctttctattgtctattctcctcctccttcagtctttactggatgttttatatgaatgtattgatacaatttggggtcttttgtgactggattccatcacttagcatatttttgaggttcactcatgttacagtgcatatcagtatttcatttctttttattgctaaataatattccatttttggatgtagaggacattttaaaatttattcattagctgatggacatttgggttggttctactttttggctattataaataatgctgctatgaacatctgtataaaggttttctgtgtacatatgtatttttatttctgttcagcatacacctgggagtagaatggttttgtcatatggtagcttcatgtttaatatttccaggagactgggaagggtagtggtagggggaaagggggggatggctaatgggtagtgaaatttataatacaaaaatatagtttgatagaatgaataagatctagtatttgatagcacaagaggatgactacagtcaaaaaatttattgtgaatttaaaaataactgattattattagattgtcgtttgtaacagaaaagataattgcttgaggtgagggataggccaggtaccccaatgtgactgttacacattgtatgcctatatcaaaatatttcctgtatcccataaatatatatacctactgtgtacccacaaaaattaaaaattaaaaaaatatttccaggaacttccaaactgttttcaaagttgtttcaccattttacatttccaccagtaatgtgaaaattccaagcattcttcatcttctcaacacttgttattgtctgtattttttgtattagccatcctagtgggtaaaaagtactatctccttgtggttttcatttgcattttttaaacaatcaatgatgttaaccatcttttcatgtgcttatggagatctatacatctactttggagaaatgcctattcaaactgtttcttcacttgtaattaagtcatttatcctttttgttgttgaattatgagtttttatatattcttgatacaagtatcttatcaaatatatgatttacaaatatttttacccattctgaggattgtcttttccctttctttacaatattgcttgcagtacaaaagttttaattttgttaaagtccaaattgtgtatttttcggttacttttgcttttggtgtcatatctaagaaaacactgcataatccattgtattcctacattttcttagaagagttttaaagttttagttcttattaatatatttagctctatgattcattaaaaatatattattattataaagtttattttacaaaagttttaaaacattttatttttaattttattttgctttgacaaataattatatacatttatggggtacatgtatgttctgatatatgtatacactgtggaatgattatatcgagcaatttaacgtatctatcactgcatatatttatcatattttatagcaagaacatttaaaatctgttattttagcaattttgaaatatacaatataatattattaactatggtcaccaggttgtgtcataaagtctcaaaaacttattcctcctgactaaagtttttaaccccttttgatcaacatctccccattttccacccctaaatccacagcctctggtaaccaccattctactctctacttcaatgagtttgacttttttagattccacacataagtgagatcacgcagtatttgactttctgtgcctggcttatttcatttagtataatgtcctccaggttcatccacgctgtcataaacaaaaggatattctttatttaaggctgaataatactccattgtgtatatgtaccacattttctttatccattcatccactgatggaaacttaggttgattccatatcatggcttttgtgactaatgctgcaataaacacaggagtgaagatatctctttgacatactggtttaaattcttttggatatatacccggaagtgggattgctggatcctatggtaattctgttttcagttttttgaggagctaccatactgttctccataatggttgtactaatatacattcccaccaatgatatacaagtgttaccttttttccatatccttgatcaacacttgttatcattcttctctttttataacagccattctaacaggtgtaaggtgacatctcactgcgattgtaatatgcatttccccaatgattagtgatgttgagcatttttcacaaacccgttagctatttgtacatcttcttttgagaaatgtttaagtgttttgcccattttaatcagattatttgttttcttttatgatacatttaagctaatttttgtgtatggtgtgaggtggggccaaatttcattatttttcatgtgtatatccagttattctagcaccaggttgtgaaagactattctttttccattgaattctcttggtacccttgtcaaaaatcagttgaccataaatgcaaaggtttacttttgaactttcaattctatttcattgatctatatgtctattcacattctagtaccacattgacttaataattgtagctttgtagtagtttttgaaattggaaagttaactcctccaatgttgttcttttttcaaggttgttttgactattctacatcccttgcatttcaatagaaatggtaggatccacttgtcaatttctgaaaaaaaaaaaaaagccagttgtgattttgataatgattccatagagtctgtagatcaattggggggatattgatatcttaataatattaagtcttttgatctgagaacatgtgatatttttctatttttttatctttaatttctttcaacactgctttgtattcttcagtatacaagccttgcatctcttttattcctaagtttttaacattttttgatgccattgtaaatattttcttaatttcacttttagattattcatttttaatgtataaaataattcattttgtatattgatcttgtatcctacaaatttgctgaattattttattatttctaatattttttcatagattcttcaaaattttctaattacaaggtcatgttgtctgcaagtagagataattttacttattcctttctaatctggatgtcttttatttatttttcttgcctaatttccctggcctgaacttccagtacaatactgaatagaagtggtgagaccaggcatccttcactatttcctgatcttaggggaaagcattcagtgtttcacaataacattagctgtggaatttttgtagctgccttttatcaggttgaggaaatcctcttctgtattcgtttcctcgggcttctgtaattaagtgtcacaatttgcgtagctgggtagacaaaactcattgtctcagacttctggaggctagatccaaaatcaagattccagcaggcccatactcctgctgaaacctgtaggggagaatttttccttgcctcttccttgcttctaatgatggccgttaatcattagttttacttgtcttgcaactgtagcactttaatctctaactgtaacatcacatggtgtttttcccgtggtcagtgcctttatgtggcattcttctctctgtgtatgcctcttttcctcttcttataaaaataccatcttaacttgactgcatctgcaaagactctatttctacataaggtcacatttgcagatacctgggctcaggcttttagtatgtcttttgggagcgggggacactattcaatccacaaaaccttctttttttttttttttttagacggagtctcgctctttcgcccaggccggactgcagtgctgctgtctcggctcactgcaaactctgcctccagggttcgcgccattctcctgcctcagcctcctgagtagctgggactacaggcgcccgccaccgtgcccagctaattttttgtatttttagcagagacggggttttaccgtgttagccaggatggtctcaatctcctgacctcgtgatccaactgcctcggcctcccaaagtgctgggattacaggcgtgagccaccacacctggccaataccttctattcttcatttgttaagtgttctttatttttcaagcttgaaagggttttgtactttgtcacatgaattttctatatttattgtgatgaccatacgatttttgtcctttattctattgatatggtataatacattgattaaattttggatgttaaaccaaccttacattcctgtgataaatcttacctggttatggtagcaatcatgttaatatgttgttgtattaggtttgataattttttgaggcgtttcaagtctatattcataaggcatattgctctgtagcttgttttcttgtgatatctttgtctggttaggaagtgttcctttctcttctattttttggaagagttgtttatatgtttggtagaattcatcgggggaagacttctgggcctgagcctttcattgggagaagtttttaataccaattcaatttcttgttataggtctatccaggttatctatttgtttagttgttcataatatcctcttttacttctttttatttctgtaatgttggtagtaatgcaccctctttttctctaatattagtaatttgaccatttctttcctaaccaatcagctaaaactttgtcaattttgttgaccttttcaaataactaaatttctagattttggttttgttgattttttctattatattttcttcctctatctgatttttttcacactaattgttattacttcctgctgcttactgtagatttacttttctcttctttttctagtttcttaaggtagaagcttaggctactgatttcagatctttttcctttttaaatataggtatttatagttatacattttactctaagcactgcttcagcctcctcccataagttttggtatattgtatttttatttccatttatctcaagatatttttgtattttcttatttcttctttgtcccattggctatttaagagtgtgttgtataattttctcatatttatgaactcccaaatttacatctgttactgatttttaattgtactccattatggtcataaaatctgcattgtatgattttaatccctttgaatgtagtgagacttattttatgacctagcatatggcctaccctagagaatatttcgtgtacagttgaaaagaatgagtattctgctattattggatgaaacgctgtatagatatctgttaggtcttgtaagtttatagtctttatagtctttttcaagtgtctatttccttgttaatttgcctagttcttttacctgttattaaaagtgagatgttgaagtctccaactatttttgttgaattacctaattcttctttcagttcagtcagtttttgctttctgtatttccttaatattttttctttcttttctttggattggattatcccatttacctattttcaagtttgctgattctttcttttgcagcttgaatctgacgtcaagtgaaaatttaattttagttattgtgctttccaactccagatattccactgagttcttatttacaatttctatctctttattgatactctctatttgttaagacaagcacatgggcttctagatcccgcaagaacatgtcagaggttgccaaaatcccctatggacacctcattctccagagcttcactggaagtttttctccagacctatgtttatctcaactagcatcacagccttaggaacctgttatgttaaagaattgctgctaattggtttggaccaacaccctggagctagggcttttcctagaaagttatctctaagtcgggccaaataaaggcaaggccatgtatataggtttattccagggagctgcaagataggtcaaacagtggcaaggttcttggaataaaattggcctttttgaagaattccaatcctggtctacactctctggtggctaaaaggctgctagttttcacagctattatggttgcaaggctactgattttcaaggctactgtggagctgggagaaagtgacgggaaaggccaacttaaaaaacctcaaactttgccatttttattgagagtcagcatttcaaaaattgttgccagcctttggttaattcccagggttcagaaaaggcgatgtggggccaggcatgttggctcacgcctgtatcccagcactttgggaggctgaagtgggcggaacactcgaggtcaggagtttgagaccagcctggccaacatagtgaaaccctgtctctactaaaaacacgagaaatagttgggcgtggtggaatgtgcctgtagttccatctacttgggatgctgagagactcacttgatcacaggaggtggaggttgcactaagccaagatcatgccactgcactccagcctgggtgacagagtgagactccatctcaaaaaaaggaaaaaaagaaagaaaagaaaaaagaaaagatgatttcgaaaattttttgaggagcagatttacacagttaccacattatattttcaagcacgggataagttaaattgtgaaaagcaaactagagaaaatatggtacaatcaaagcataaagttattcaaggcttggtgactctgcattaaatatttatataatataatagttacctggggaaactagcccattactacctgtgttctatcagcaatgtagagagcactctgtttgtatgctttgagaactttaagagtttcatgcatactttagaaggaaaagtactattgggttattgatcttttctctttaatcacatagaagctttaggggagaacaaaagggaataaagaaaatacatgaagaaatggtaggtcctggcaagaagatttctaataatgcttttcattattgtaccagaaacccaaacctcaaactactagtgtgggtcaatttgctgatttaattttgtacaactccaaaaaatacacaaaatatataaaagaaaaattcagtttccactaccgtacatatttttatggtggatgagatatatgatgccatcgatccttccacagataactaaaaatgtaaggcactacttccatatttgaaaaatgtctccctttttagtaaaataatttgagacactcaaatagctgccttagttactacatacaataagttcaacttttaaaattaattatgtgattatagaatgtctgtgtttcaagtttcctaaagaatgccttcaaaaacacagagattttgcagccttagaaatgtttattcaataatttgaaaagtattgaatttcttgcttcagatagttttcaatattatatagccaaatcagccaggctcaaacaagatttcacttctctattgaattcatgtactcttagctcagccaagcacaaaacagctaatgctgtcacgtttgaaaagcttttacgctgaatttgacacaaaagcaatcacaaagccgacaaaaaggggatttctctttcaaaaactgacaggggaaaaaataaatgaaaactcggagcctgggaaaatctctcttgacactggaaaagaaagtttaaaacgatcaagaaataatttttccaaagaatccattgccaagtttggaccaatcttaaaagcctagggaacaggttatgaactcaaccaagaatccgccaaatgaaataaatcctatgatgatcactgttggcagttttaggtgccaatggcatactatttttgcctcttgtgaaagttctaaatggcatcatctctcataggattctgtcatagcctattggcaaagattttgattagaatgaaaatcttgtatgtttttgcctaacatctgtctttctatctcaaaagaactttattgttgtaccaggcccatagagaagataaaattaaaccatgaagccatgtggctaacaaaattaactactttctaacttcatgtttttgttttagaaaaaattaagggtgaaagaaaacaattaccaatatgttatggccgtctcttgatggcctgctaattaattgttgatactctatgccatctgcattctgttttttcaccaaatcaagactctcctgttgctgtttctttccactctgaccacgctttcaagataagctttttccacatgacatctccggttttatttctgttctgtgaataggttgttattgtccccatttattctccttatttatgtatttttgagacagagtcttgctctgtcacccaggctggagtgcagtggcgtgatcttggctcactgcaacctccgcctcccgggttcaagcgattcccctgcctcagcctcccaagtagctgggactacaggcatgcagcaccacgccaggctagtttttgtatttttagtagagacagggtttcaccatgttggtcaggccggtctcaaactcctgatctcgtgatctgcctgcctcggcctcccaaagtgctgggattacaggtatgagccaccgcgcccggcctcaccattctttttttctaaataaaaggaggagttttttctaaatgtcagaccagcaaggacataaagatggaaattaatgaaataatataaagaagttaaaataattattaaaagatgtttaacaacattgataaatatttatgcaatattaagtttacaaatcagaatttaaaatttaatttacattatgtagacaattaaaatatatgtagataagaactagaagagactgtcaataaagattagcaattatgaatcattaattgctttttggtatcaagcatttttggtaattttctttttacgttcaggtatggtgactggctcaaattttaagagttataacagtgttggtggttgggtttgaaacatttcattgttgctcagtagtgagagttagtgtagtcatcactgaggtgctgcaaaggaggctggctgctgtaatcacagctctccaaggctgtagacatagctttgtgattgccttgtgaggctcacaggctctcttgttaatcttaggcacacagactcagaaagaacttacggagcaagggggtgttgctttagccatttaatgtctcctcctgtctattttcacacttttttcctaaaagaaaattttaagtaataagccagctaatatcacttagtagtgatgacacattcgatgtaaagaccagataaccattttatttgctccctaccttttagaagaattaaacattgtcgtttcattaaaaatgaaatgcagtttgcaattattgttttattttttcatcaaagaatataatatgaaattttttttcgcagtatactatttcattgctttcattttctacctgttggtttatcagtaatgtaatataatcttatttgtcaattaataattacatgagtctttttcagattcttatggggttttcttgctttgttttagccacgtagacaattggaagaggaagcctgtgaggtcatctacaagagtaattgctatgcattcgcatcacaactctactactttcaaaagaagattctgaacttctctagccttcagttttcttctctgcaaactaagaataataagagtacttttcaaagagtgtttttgaaaggatgaaataaaccaatatatataaagtgactagcatactttttgacacacagcaagcattcactaaaagttattattaacattaggattactttaattttagcatacatcattcaagaaatggatgaaaaaattacagctttggccatctttatctgtatcgggaacttacattgaatctgcagcaatacacatcattaaattcctaaacacagagcacaaacaaaaaatgtcaatctctatagatagtggctgagccatttttatgatgtagttttagaccattccaaagcgttttttttttttaatttcaaaagtttgacaaaggatagcaattataatacaattctggttttattttaggtgattaaaacatcttacatgttttgacaatgcaattgttttgttttctactttcatatttccttctgcagatatttttgtctcttatttaaagctacttgctcttctaagagcaattaaaccctaaccattcttaccatcactttaggattttcttaggttaaatttatttctcatttgctaactaccagagtcctcttgccctagtcaaatctatcactgtatgcctctcatctctccttcttctcatctaactcaaggatccagtccaaacttcgtattttctgcttataccttcttaccagttaactactttggtttgtgatccaatagattcatagtatccgaaacttatagagaagaaaaagaagtagcataacatgctgactacctcacgaatatgactagagctttcaagaataaccacatgattctatatattacatagtcagaccaggaattaggaaaatgaccattggagattcctaattcatctatgctcatccattgaaaaaaccattagtggtaacatgtgtctcttgaaagaatttttattcacctagattttgactccaacagagctaatgataagactgtaaaattctatgtggctttctaacatcctcatcatataaactaaaaccttgtcctcatagcagctcaggtcccttcgataaaatggctatgacagagattggctaaaagctcactaattccattaactcttcctgaaattcaatcgagaacaagttctgtgtgatgggatgtggtggaagtgatatacataatttccaggcctggccataaaacaccatggattgactgaccacattctgtcttccttttctgcagtggcttttggcagtgtgttgaaaatgacaagtgtcacaaaattggaaaagtctgggtttccaagtgaccatgttgggggacagctcctaagaatggcttgtcaacctctactggactatgatataaccaagaaagcagtctttattgtgttaagctattgagatttcagagttcatttcttactatagcttagcatagcctaacctgactaatttggaaatggaagccatttcatccaagaaaatgatacggtttccttcttagatgacataaccaatttgagaatcagatactggtttagcaaaaggccttttctgtcagataaaatatctatagagggttttgatcaagtgcccaatctgatcaacctcctaccatgttacttccctgctcaaaataccctaaagcttaaccattgtttaacatttaagggcttttcaaactgactagtaaatactaagtttgaagggattaaacgcatgcaaagcactatgcatgctgcttgataaaacatagttattaagcaattttcttccttttcctttttcttttatcctgaggaattatagactactaagcagacagatatttgaggaaatttcagaggaaagagaaagaagagaagaatgagctgggctggaggtaagagaatggggggagaaagtgagagtactccttattcctccccaatcctgatacccactcacccccatttcttgatccagggcctccaaataagatatgaaagagtagacctgttactttttctaggaaggaattaagcccgaatggttgacttcatgcaactacataaatacgtataccaattttgaagtgatcttaaagatggtgcaacagaaaaccagccaactatatccagattactaaacaaaattaactttaacattgacattagctgtcaattttcctctattctctaccttgactcaaaagtctactggctaggcatgctaactcatgcctgtaatcctagtgctttgggaggccaaggaaggagaattgcttgaggccaagagttcaagaacccatctctacagaaaacaaaaatttttaaaaaattagccaggcgtggtggtacacgcctggctagtagtcccagctactagggaggctgaggcaggaggactgcttgagccccagagttcaaggctcagtgagctatgattgtgccactgcactttagcctgggtgacagtgagactctgtctctaagaaaataaatatacaaagtctactgttcatttcagctttaacgtgattttctgttaataactttacattaaacatcattaaattacaatctatggtataattttatcaaatgtaaccagtattttattttaaaaaggtatctttgatactaaccttggtttctgtgattttcttttggattgcatctactgtatagggaccctccttccatgactcaagcttggctctggcctgtcctaagacctgctcagcttcttccttagcttccagccattgtgttgaatcctttaacatttcattcaactgttgcctccggttctgaaggtgttcttgtacttcatcccactgattctgaattctttcaactagaataaaaggaaaaataaatatatagtagtaaatgctagtctggaggagacattttaaatgtaacttccaaacgttatctcacatttatgttgcttatttaaaaaattattcattgtgttatggctaggatgatgaacaacaggattctttgcttttttgatggcaaatattagtttctgttaaattattttcctgaaggtgacatagaacatcaacatatatataaaattttaactcaattcttgatccctagaaccaaatatgaatcatctgttagaaaagcactacagcagaatatccatatcccctcatccttgccacttcagcacccatcagcctgatttcccagtgccagcatttcattgcctgaaggctttctgttgccacaggagtttgctttgccatccatgtgacaggctagacataccaggcaactgatgcctcccctccagctcccagaggcagcctgtatataatgactaattgtaggaattgggatattgttacactagctcccttgatgctaggggaaataactctgaggcatgtattttacaagggttccagagtttcccaagggataaagctccagtgacccacaacagcagctggcttgataatgcaccactctttactggctgccttgcctcacctgtctcatttttccactcttctactgattaatttaccccccaaataaatcacttgctcttaaaaccttttccaagggtcttctgagtgaacccaagggaagataagtgtattagaaacttcttctttttctttcttttttttttttgatggagttttgctcttgtaacccaggctggagtgcaatggtgcaatctccgctcactgcaacctccgcctcccgggttcaagctatcctcctgtctcagcctcccgagtagcaggaactacaggcacgtgccatcatgcccagctaattttttttttttgtatttttaatagagacagggtttcaccatgttggccgggctggtctcaaactcctgacctcaggtgatccacctgcctcggcctcccaaagtgctgggattacaggcgtgagccaccgcgcctggccaacttcttttaacaatacctaagaattcacgctgggtgcattttgtaagactggcttatattgaggctatcactggtatcattggaagtccaagagggaggtactatatagattctactctgaaatatgttcttttcaaatattaaaataaacaggactacattattttttctatgcaacttctctaagctggttttatgaaataaaaataatacagaaaacaagtaataaaactgccatctactttatcccttaagcatgaaacctgatagacattctagattctttcctaagcgtcacccaacacctcatataattagttacaaatttctctcatatataacttctttcctctttctattggcactgcaaacctctatcattttttgccctcacatccataagaggctctatatcatcctcccagacccaaatctctgttttagaatgtaaattctaccccaattaaagattaaaactaacataaatctgatcactgcactccctcttataaaacccttcaatgtttccctactgtcttctggaatatcttagctggacatacgtgttcttctatgatcttgcctagataatctgagaggtttatctacaaagcaacaaatcacaagataagcagggtataagaaaccatcacagataatacaagaaccttgcaacagtagagctgttactacatctaggcccaagggatgaggggagggaaaagtggccaaaagcagagaattggaatgagaaaccaccctgagaagagcaataaccttttgtcaaaggacatagtcagcctgtggcaacctcaaagggagggaattaggagaataaatatcttgacctcactttacctcctgtcttcaatttccttctagggctcttgggtgcctaaaccaactggaagccaaagggcatgggagcccaatgatgacagaggtcagcctcccagaataaagagcaagggagagaaggtcaaagaatggctacagatggacaaacaaaatgtatatggcacaggaatataaaactatgcttcttattttgttatgtaagtaaagtcctttttaattaaccctgttgcctccacaaagttatgtgaagttataagttaaagaaatacttgagatggccaggtgcggtggctcacgcctgtaatcccaggtctctgggaggccaaagcgggtggatcatgaggtcaggagttcgagaccagcctgaccgacatgctgaaacccagtctctactaaaaatacaaaaattagcacacgcctgtaatcccagctactcaggaggctgaggcaggagaatcacttgaacccgggaggcagaggttgcagtgagccgagatcatgccgctgcactccagcctgggtgacagagcaaaactccatctcaaaaataaatacatagaaagaaatacttcagatattttgtaaataagcatcaggactagaaagaccccacaaaactagtgattgtaacatgaaatcaaaaatatagtccccagaataattaaaactcagtaagtggcacacattatagactactgtttttttatcaggtttatttctgtttgggtgtttgctatgtattgcaaaactagtcgacatattatattgcaacttcagttaacatgtcaacctctgtttaaccgtaagtctctctctaatctttgaacgccattgttttgtgtgtctcattgttgttgttccactaggtagtggaacagctttcgtagttgaggccttgtaattgtttagtcttctaattaatctttggtttataaaataaatggtgtaaatgctcttataagaaagctgtataaagtgtaaatgaaaatgtctttaagtgttctgaaatattctgtggatattccaattacaaaccctttttcaacttatcatagcaggctactttagtacacatacttgggactttttctcatatcctactgttatgtaccatgtgtatttgaaaataatacagttgacattccttaaaaatagtctctgattccaatttgccttcgctttcgttagtcttaattactaacattttactatgctagcaatattttttagaatgcctagtggttttcacataaacatagcaagctcttttgattcatgccagtaaatattttgtacatcctacagttcatttcaatagggaaaacagtctatatttttaaaaggccatctctagatattaggaaaagataaagcagttcttcctattatgtaggaagataattttaatcctggaaaaagaaggaaacttttataacctgaaccattatttcaggcaaacatgggatttgaatgcttgctcaataatagaaggctttcagcaaaaaagtggtcatatgtgtgttatgtagcaagttaaaatggctccttggggtgtgcatcccactgagggtatgctttttcacccttgaccttcaactgtacattatcataatttattagttaattaaaaatatttataggctagagactcactcaataatccatctatccctctgtgcatccccacacatccatccatgtagccagctagtctctattttatttaccatctgttagacaccagccattatgataagaacttggaaaacaaaagggtttaagacagattacctggcttctggtttaggtgcctgttagatagtggtgctattcactgcctatccaaagaatgcagagtgagcatggagaagataatgagttcagttttggacctattcactgggaggttgtgaggaacacacacataaaactaacattttagtcaggaggactgaaggatctatagcatagctgtgtattttgggagagacagaaatctgggattggccgtcactacagagaaataaaaagcaaagcctcaaatgcaagtgcattctcatttatatggcacatagactgagcccaacaccgggctgggaatggactcctggaaaatacaacgtaaaaagaataaataaaacacaaagagcaaataagatgaatgaaagactagagaaggaggaggaatatcaagaaagtgtacttttatagaacatggaaaagaaagattttcaaaaacacaagagtgattaacactttcaaatctcatagatgtcacaagacataataaaaatcataactaacatttatttgaatatctacactgtctgaagctctgtgttgttctttccttgcattaatcacttaatcatcatacaatcctataagtataattgtttacgttctttttctattgctgcaattatcctcatttaacaaatgaggaaataaagacagcgttaaataactggtctaaggtcacatagatagtgattgttagagccgacacttggattcaagaagttagacctccaaagcccatgccaaaagtatccattggctttggccacatggaattccctgaagaccatacacaaaatgatttcagtgcagtggtagaaatcttactgtaggagattaaaaaatacctatgaaaaagtaaggacagtaaattgtagactatccaaccatagatcattataagaaggaagtcagaggggagtttggtgtcaagagaagttttttcccaaatatggaaaacttgagtatgaatataggtattgattggggaaaatggtcaaaagacaaagatgatgccagatggaagaaaagtccctgagaaggtgcgtgtattgaacattaactaactacctccttctcctgtgtttcccctgttatttttccatttgtgcagttttcccacaatagacctctctttgctctgtggatggtgtgtacttagttttaactcatctccctggctttagtggttaattcaaagatggacttatggttccaagtaaggtcaatcagaaccaatgaaacaactctaggatttttgttgttgttgttgttgttcgtgattctaaaagagaaaacccattgcttcttgtttaagatggatgagaaagcacgtagttctgcagtatcctgatatccatcttagaacaattaagaggaattaaacggaacaaatactggggagcagagccatgcaatggagaaggaaaactagaatctggtcatgctatttaattcctgaatcaagcctcgtctatctttcaactgtttaatgacactgatcaatacattttgtctgagtaagtctaagctactttgaaatggattttccattactacaatgtacaagttctaacttatagagagagacaaactcttttgatgtaaacaaaggtctcctaggaattgtacaagaatcatgggaattgtacatgggaatagctttcaaatacaaaagtttaaaagaggactttgatcctgcttaaagtagctttaactagggtatctagataaatacactgaatgcttatatcaccttggaggagttcctacataaaaaatttccaaagcccatagaaccaaaacttaccaaaaatgttatggcatttagacaacattattctgtgagccttatgggtaggaagggatttttgccaccaatgtttacctctttctattcaatttctttatattatgaatacataaatgaaaatgacactcaaaaagagagacatctggggacaaaattatcccaggacattcacatatagggtggccacgcctggttacatccatggtttaaaataattctactctttttcccttttaagtagatctttgataacggaacacccactcaaatgtcatcatcacatataaagacttcccctgctctcatatgtgcagtcattttctctcaccgtggttctcccataacactttgttaagattttaaaacttgtactgtgtgctactatgatttacatttttacattttacatttctgtctctgactctagacagtgtccttgcctcaaaggcaaggacagaatctgtagaagatgctgtcagggcccatctatctgccgttggcactcatccttcaagtatatgccagcagtgtcctagtacaagcatttgccctactgcaaacctgagagattttcctcagcttgctaggtgcgctggccagaagtgctggaaagtttatgtaccaggaagcatttagccaatgatggataagagttggaatagttagccctggttccttgcctttacccccttgtggttgacaactttgaggcatgttttttgtttgtttgtttgtttactatctcccagagctccttcatcaggatcaaaccccagtggcccaaagcaataactagttccataactggcttaattattggcttctttcatttattatctcattgtcccactctcctactggtacttcctgggatcacattacaaccaaaccactttcaccattaatcattgtttaaaggtctgtttctgaaagaagctagcctaagttagtattttatccatttaaaaaaatccttctctggcaaagcggaagaagctagaaaataaaaataaagtaaaaagtaaaaattaaaaacatccttagtgcacaaactagtgtttggcatttggaataccttcaataaatgtctgtcaaatgagttgtacatgtagattatttccattatccccactttctctttataatgatataaaaatgccatttctaaagttaacctttgcccagcatcttcagtctttcttcttaagtaaccactatttgtttgttgcatttcaagttttcataatttgaaaatggactcaagactttcccatttccttccttattttcctcttatgcttatgctaatgatctctattccaggcgaacaaatgtcctctgaatttcctttgtttcttatttaatgcctttgtatcaaccacattcatttgtataaaacatctttaatgtcatgtttactagtagaatatctgtgccttatataaaatccataaattaaaagatatgggagggtcaaataattcagtaagccaaaactaatcaatgacctctctttccctaactttcttaaaataactataggttagagagaatctgttggcatatcctattgcctgtgtctatcttcttaatcaaattacagataaataatttagaaacgtccctctatatattgaagccagtggattagggtctcccacatgacctagggagacaccagctggcatggctaagggagtggttgcaccatacctcccctactcccagcagtgaagcttgcagcaacagaagtgactccttacttctcgttaaggagaagagagcgaaaagtaaagaagactttgtcttgcatcttggataccagctcagccacagtaggatggggcatgggcagagtcatgaggcccccattccaggccctagttcctggatagcatttctagacacaccctgggccaaaagggaatctgctaccttaaagggaaggactcagtcctatcaggattcatcagctactaactaaagaggccttgaacgttgaataaccagttgcaatacccagggagtacactgtgggacttggcctctgagatgtgctggcttcataggtcacccagcaaattcccagctgtggtggttatggtgaaagaccccttctgtttgagaaaagtagacagaaaagtaaaggggactttgtcttgccccttaggtaccagctcagccacagaaaggcagagaagcaggcaggcttctgggatttctgagtcctggcctaggttcttggacagcatttttggtcctgccttgggccagaggggagcccaaggccctaaaatatgggtcccagttctctcagcattcaccacaagctgatggaagagcccttgggctttaagtgaacaccagtggaggccaagcagaaccctcatggtggtgagggccacagggagaggatcctctgccttttaaaagggcaaggaagagcagggagcactttatattgtggtgtgagtgctagcttagccacaatagaatagaacatgaggtaaactgctaaggtttttgactccaatgactggccctcagacagcatctctggatatgcccggggcctaagatttccaccgaaaaatctgctgccagatgtattgaagctccactgcatgttatttgtttcctttctcttgctgcttttaggattctttctttatccttgacctgtgggagtttgattattgcatgccttgaggtagtctctgagataattctgcttggtgttctataactttgtcgtacttgaatgttggtatctttctctgtttctgaagttctctgatattgtccctttgtatcaactttctatccctatctctttctctacctcctgtttaaggccaataactcttagattgacccttttgaggctattttctggatcttgtaggcagacagcctatttgaaaatacacagccagagaagacaaaagaaaaaaataataagaaacaatgaagcatacctacaagatccagacacaaaaaacccttcaaaaaaatcaatgaatccaggagccagttttttgaaaagatcaacagaattgatagaccgctagtaagactaataaagaagaaaagagagaagaatcaaatagatgcaataaaaaatgataaaggggatatcaccaccgacaccacagaaatacaaactaccatcagagaatactataaacacctctacgcaaataaactagaaaatctagaagaaatggataaattcctgcacacatacaccttcccaagactaaaccaggaagaagttgaatccctgaatagaccaataacaggctctgaaattgaggcaataattaatagcctacaaaccaaaaaaagtccaggaccagacggattcacagccgaattctaccagaggtgcaaagaggaactggtatcattccttctaaaactattccaatcaatagaaaaagagggaatcctccctaactcattttatgaggccagcatcatcctgataccaaagcctggcagagacacaacaaaaaaagagaattttagacaaatatccctgatgaacatcgatgcaaaaatcctcaataaaatactggcaaaccgaatccagcagcacatcaaaaagcttatccaccatgatcaagtgggcttcatccctgggatgcaaggctggttcaacatacgcaaatcaataaatgtaatccagcatataaacagaaccaacgacaaaaaccacatggttatctcaatagatgcagaaaaggcccttgaccaaattcaacagcccttcatgctaaaaactctcgataaattaggtattgatgggacgtatctcaaaatagtaagagctatttatgacaaacccacagccaatatcatactgaatgggcaaaactggaagcattccctttgaaaactggcacaagacagggatgccctctctcaccactcctattcaacatagtgttggaagttctggccagggcgatcaggcaggaaaaagaaataaagggtattcaattaggaaaagaggaagtcaaattgtccctgtttgcagacgacatgattgtatatttagaaaaccccatcgtctcagcccaaaatctccttaagctgataagcaacttcagcaaagtctcaggatataaaatcaatgtgcaaaaatcacaagcattcttatacaccaataacagacaaacagagagccaaatcatgagtgaactctcattcacaattgcttcaaagagaataaaatacctacaaatacaacttacaagggatgtgaaggacctcttcaaggagaactacaaaccactgctcaaggaaataaaagaggacacaaacaaatggaagaacattccatgctcatggataggaagaatcaatatcgtgaaaatggccatactgcccaaggaaatttatagattcaatgccatccccatcaagctaccaatgactttcttcacagaattggaaaaaactactttaaagttcatatggaaccaaaaaagagcccacattgccaagacaatcctgagccaaaagaacaaagctggaggcatcacgctacctgacttcaaactatactacaaggctacggtaaccaaaacagcatggtactggtaccaaaacagagatatacaccaatggaacagaacagagctctcagaaataataccacacatctacaaccatctgatctttgacaaacctgacaaaaacaagaaatggggaaaggattccctatttaataaatggtgctgggaaaactggctagccatatgtagagagctgaaactggatcccttccttataccatatacaaaaattaattcaagatggattgaagacttaatgttagacctaaaaccataaaaaccctagaagaaaacctaggcaataccattcaggacgtaggcatgggcaaggacttcatgtctaaaacaccaaaagcaatggcaacaaaagccaaaacggacaaatgggatctaatgaaactaaagagcttctgcacagcaaaagaaactaccatcagagtgaacaggcagcctacagaatgggagaaaatttttgcaatctactcatctgacaaagggctaatatccagaatctacaaagaactcaaacaaacttacaagaaaaaacaaacaaccccatcaaaaagtgggcgaaggatatgaacagacacttctcaaaagaagacatttatgcagccaaaagacacatgaaaaaatgctcatcatcactggccatcagagaaacgcaaatcaaaaccacaatgagataccatctcacaccagttagaatggcaatcattaaaaagtcaggaaacaacaggtgctggagaggatgtggagaaataggaacactttacactgttagtgagactgtaaactagttcaaccattgtggaagtcagtgtggcgattcctcagggatctagaactagaaataccatttgacccagctatcccattactgggtatatacccaaaggattataaatcctgctgctgtaaagatacatgcacaggtatgtttattgctgcactattcacaatagcaaagacctggaaccaatccaaatgtccatcaatgatagactggattaagaaaatgtggcacatatacaccatggaatactatgcaaccataaaaaaggatgagttcacatcctttgtagggacatggatgaagctggaaatcatctttctcagcaaactatcacaaggacagaaaaccaaacaccgcatgttctcactcataggtgggaattgaacaatgagaacacctggacgcaggaaggggaacatcacacaccggggcctgtcgtggggtgaggggacgggggagggatagcattgggagatatacctaatgtaaatgacaagttaatgggtggagcataccaacacggcacatgtatagatatgtaacaaacctgcaagttgtgcacatgtaccctagaacttaaagtataattaaaaaaaaaagtaagttgtgatgttagaaacataaaatgtgggaggagggagagtcaaagtgttgagtatatgcacacaatcaaatttaagttattatcagcttataaaatgttttatgtaagcctcggagtatccacaaagcacaaacttataatacatacatgaatgataaaaacaaaagacccaaagtatactactacacaaaaccatcaaaacacaaaggaagacagcaatagaggaagaaaggaacaaagaatctgtaagacaaccaggaaacaatgaacaaaatgacactagtaagtccttacccatccatcattattttgaatgtaaatagattaaactctccaatcaaaaggcatagagtggttgagtggattaacgacaacaacaaaaaacaagacccaaatatgtgctgcctacaagtggctcatttcaccttaaaggacatgcatagactgaaagtaaagggatgaaaaaagatactccatgtacatgagaacaaaaagagagcagggtagttacacttacttcagacaaaataatctttaggtcaaatctgttcaaagtgacaaagaacatcattatatattgataaaggttatttcatcaagaggacataacaagtatataagcatcccaaatcagagcacctaaatatataaagcaaacattaagggatctgaagggaaacatagcctataacataataatagcaggcaatttcaatattccactttaagcaatagacagaaaaattcataagaaaacattggacttgaatgacattttagaccaaatggacctaacagacatatacagaacattgtgccctgaacagtaggaaaatacagattcttctcaagtacacatgtaacattctccaggatagatcatatgttaggccacagacaagtctcaacaaatttaagaaaacccatcgtgtatcttttctgaccacaatataaaattagaaatcaattacatgagaaatcatataaaattaagaaatatgtggaaactaaacaatatgctcctaaacaattattgggtcaaaagaagaaattcaagaggaaattttttaaaagtcttgagacaaacagaaatgaaaacacaacatagaaaaacttctgggggtagcaaaagcagtgctaagagggaagtttatatcaataaattcctacatcaaaaaagaagaaatatctcaaatgaaatacctaacattatacctcaggaaactacaaaaagaagaatgaattaagcccaaagttagcagaaagaagaaaataacaaagatcagagcagaaataaatgaaatagagactagagaaacaatagaaaaaaagtcaataaaactaaaagttggttttttgaaaagctaaacacaattgacaaatccttagctagactaagaatgaagagagcaggctcaaataaatcaaatcagaaatcaaagagaagacattatgactgataacacagaaatacaaaggatcctaagagactacgatgaacaattatataccaagaaattggacatcctaacagaaatggatgaattcttagaaatacataatctaccaaaactgaataatgaaaattggaaatctgaaaagaccagtaacagctaaggaaagagttaaggagattgcatcagtatttaaaagttctcacatcaaaggaaagctcaagaccagatggcttcatgggagaattctacaaacatttaaagaagacctaacacaaatctttctcaaactcttttggaaaactaaagaggaagggattcgtccaaatttattttacaaggccagcaataccctgatcccaaagccaggcaaagacactacaaggaaagaaaactataggccaatatcacgaatgaaattagatgcaaaaattctcaatgaaatactagtgaaccatatttaatagtttattagaaggattattcaccatgaccaagagggatttatccctgggatagaaggttgtttcaatatatgcaaattaataaatgtgattcaacatataacagaatgaagtacaaaaaccgtatgatcattttaataaactcagaaagagcatttgacaaaattcaacatccttttatgagaaaaactcttagcaaattaggtatagaagaaatgttctccaaaagaataaaagccataaattacaagcccacagctaacatcatgcacaacagtaaaacgtagaaggcttttctctaagatcaggagcaagacaaagatgcccactctccccacccttgtttaacttagtactgggagtcctagccagagcaattaggcaggagaaagaaataaaaggcaaccaaactgaaaaggatgaagtaaaattgccccttcttgctgatgacataatcttatacagcaaatcctaaggactccactgaaaactgttagaattcatacacaagtttagtaaagttgcagggtacaaaatcaacttacaaaaatcagtagcgataacaattgttattgtttgtacaataacaacaaactgtctaaaatagaaattaaggaaacaatctcacttataatagcatgaaaaaatatttggagtgaatttaaccaagaaagtgaaagatctgcgtgttgaaactataagacactgacgaaagaaattgaagatgacacaaataaatggaaagatttctgtgttcataaattggaaaaattaatattgttaaacataaagcaatctaaagattcgacacaatactaacaaaatctgcatattgttctttatagaattttttttaaaaaatcctaaaatttgcatggaaccacaaaagaccctggatagccaaagctgtctttactaaaaagaataaaattggaagtatgtcactactggatttcaaaatgtattacaaagctataataatcaaaacagcatggcaagtacataaaaacagaccaatggaataagacaaagaggactaaaataaacctacacacctttgatcaattgatttttgacaaaggtagcaagaacacacaatagggagaggacagtctcttcaataaatggtattgggaaaactgaatgttcacatacagaataaaactggacccttatctcaccccttatacaagaatcaactcaaaatggattaaagccttaaatgtaatacctgaaactaaaaactacaaaaacataagagaagagctccatgacattggtctgggcagtggtttcttgcatatgacccccaaacacaatcaacacaaaaataggtaagtaagattgcatcaaactaaaaagctttgcacagcaaaggaaacaattaatggaataaagagacaacccacagattgggagaagatatttgcaaatcatacattagataaggtgctaatatccaaaatatacaaggaactcaagctactcaataacaagaaaacaaataaccctaataaaaaaatgggcaaatatatgaatagacattctcaaaagatgacaaacagcatatatatatatatatatatatatatatatatacacacacatatatgtataatactcaacatctctaatcatcaaaaaatgcaaattaaaatcacaatgagatatcacctcatatcttttggattggctattatcaaaaagttgaaagataacaagtgttcatgaggatacagagaataaggaaaccttatccactattggtagtattgtgaattagtaacggcctccataaagacagtatgaatgtttctcaaaataataaaaagagaatgaccatatgttccagaaatcccacttctgggtacatactcaaaagaaaaggagggagtgtattgaagagctatctgcactctcacattgttgtagcactgttcacaacaggcaagatttggaagcaagctaactgtccatcaacatgcgaatggatacagaaaatgtggctcatataaatgatgcggtactatttagcaataaaaaagaattatatcctgtcatttgcaacatcttggatggaactggaggtcattacattaaatgaaataagccagtcacagaacgaaaatcactgcatgttctcacttatttgtgggatctaaaaattaaaactattgaactcatggagacagaataaaaggatggttaccagaggctacaaagggtagtgtggaggtaggggataggtggggattgttagcggctacaaaaaatagttagaaagaatgagtaagacctagtatttgatagtgcaacagggggactatagtcaataataatttaattgtacattaaaaaataactaaaagtacaattacattgtttgtagcacaaaggataaatgcttgacaggatggatgcctcattctccatgatgtgcttgtttcacattacatgcctatatcaaaacacctcatgtaccccgtaaatatatatacctactatgtaccccaaaaaattaaaaataaaaaaaaaattttaaaaacctaggaaattctgtcatttggaataataaggatgagcctggaggacattaggttaagtgaaataaacttggcacagagagacacatatcatataatctcatttgtatgtgcagtttaaaaaaagttgaactcatagaaatggagagtattatggtggtgatcaaaagctgcagtggtgggtggatggaaaaatgagagacgtttatcaatgggtacaaagttccagttagacaggaggaataagttctggtgttcttttgcacagcacaggaactatagctaatattgtcatattgtatatttccaaatagctaaaaaggaggattttaaatattctcaccacaaaaatgagaagtatttgaggtgatagatatgctattagcctgatttgattattccacaatgtatatatatggattgaaacatcacaatgtaccccataatatagttgtcgactaaaaacgaaataaaatttttaaaatgaatattatttgagttgtaattccactcccaggtgtatatccaacagaaatgcatagttattaatatattcaccaaaaaccatgtactagactgttgatagcatggctatggattgcagaattgttgacagcaatttcctcatgttggaaactactcaatttctcatctatatcaacatgtgtaaatacactgtggtatcaatagaatattattcagtaagaaaagtgaacaatccacaactacatacaataatatggatgaatctcacaaacatattgttggggggaaaaatacagccacagacaagtagatatgactgttcgattccttcatataatacacaaaaacaggaaaaagtaatagaaaacttttgaagtaaggatagtagtcacccttgtgaaatgttcatgactggagaagacatgaagggggatcctgagcttctggctatattatattatgtttcttgatttggatgctatttacacagttgcattctatttatagaaattcactcttctgcatatggctagccagttctcccagcaccatttattaaatagggaatttgatttgtgaaatatattctacatacaactttggacaattcatcttttttaaaaaaggtgtcacgtgtgaaatatgtgtcattttggctgctgtgaataataaaagatgcaatcattctgctacaaacacaatacgattttgactgtacattgatgtgacaaagaacatttcagaaattcttattggacagtgaactggactagattcacagacacacatcagcacatacagacgaatcaagcagctattctgctatttaataaaagaaacaaagcagtacaattgattgttatagtagtcccaagagtagaccctgcagaaatatatacaaaagacaattttagaagttttaaatgtatttcattttgtcaaggaatgaaagcaaatctaaaatctgaagatcatcagagcgaagctgttatcctaaaagtggatcagtgtggtagtctgacatcatatagacctggtaattgtccataactgagcatcaatttatactacagaattttaccacacttgcgacacttcacccaggagactgacagatcaaaaacatattatggcaatgtatttggccactagagcccatattgttagatttacatttacaccaaattcatctgacatacaaaagtgaaataataataaagtatatgcacataaacccagacaatctgtgcatgtttgtaattgaagagctacccaatgtacacattttttttttctcacaaaggtccgtcatggaaagcttctcgactaatttgtgcagtaaatagatgttgggtaataaagggaaataaataaccaatgctaagactcaggatgacagactgagacccagcatgtgtcctgatttacgaacctccagaagtgtcaaattggaaactcagcaatcatgtcaagaaccacaatattgcagagaaagaaacagttcagttgattgaatacgaaccaatctttcacttcaagttttttagactagctatgtttaattatcgatatacattcttgactgatataaattcccacaacatctctcttagggaggaatgttatttatacacaagaaatgattaccttttgaatacacattgctacagaacaaagaacagttctgttgcaatttctgcactgactgtacagcacgagaattagaagtctgtgtaactgatttttagaaagcaactttgactagcagttagtcttgggttataaccctggattagcgatgaaatagtggatttaaatgggaaaagttgatttgccacgatctcagtttcctcaactcccaaactgaaataatgacaactgcagaaccacagaattattgtgaagataaaattcaataatgaataaaagcataaaggatcctactaaagcaaggtgctactgcttctctgtatagacaagactaaacaatgaattatagttatcaacaaacattcacgatctgctagggagtgcacactatggatctcactgatcccacagagtacgccagagttccaggtagaaaatgccaaggtgaaaggcttaaattgcaggtaaatcttttgaggtcatttgagtgagtgaagagtgacggacatgactaactgtgggcaactctaaaggaaaaatgatcccaattgcagttaagacaaagatttctaaactatttgttgggatcaggaaaaagggagaaatagcagtagactgttctccgaggctaaaaccatcaaaaaatgttaggcatgatcaagaatgaagctgaaaacaaggaaaccaccattattgtaaccttgtacaaagctaggacacaactatacctagagtaatgtaagcataactcaatgtttgacatacaaagacatataaggaactgaggaaagtccaaataataacacagattataaggaatattaagatatgtcccttctacttccacaaggcatttaaacagggttctgtggaagacctatctatagttaagctttgcaaaagaagtttcaactcaaacccacaaagaggaagaaacatatatgctaaccatgtagctagtatgaacgggcattttttttcacttagatatagaaaaggaggaatgtggttgttttacaaatagagaataaagtatctgagatgtaacagatcaaaaagctaaaaacagaggggagttattggcacataaataaatcctggccactatgatgaccaagttgctttttctctaaatcccaaaaagctagaatgcagaaacagccaagcattttggttaagttcatggaagccagacccagaacaaatgactaaattttaaaattttataatattagcctaacatttaaggttagtttggaacatggaaaagatcaacagtttagtgctattttcacactgtttactcctctattatatggggataataacaagaaaattaataatctagaaagataaaaggaaataatgtacacaaggcactgagaaaagtacctgacccctagacagctctcaattataggggcgtaaataggcaatcgtgtactttggtaacactgttggacttttctggggcttcttaaatcctgagtcataaagcaaaggaggatagattggatgatccctggagatgttttcagctctaacagtttgtgaaatacgtttcttgatgcctctgtcagagctgaaagctcaccttacaaggtttttgtgaagaactcacccagcccagtgcctagatgaacaaatgacgtatcaatagccatactgttcccctggatggacctttggtaaatttcaacttggcaatcttatggtcatatattcagtcatgctacatgtcagttaaaggaaactcaagccaacctaaaaaatgttccctcctgtctgggccaaggctatttttttgtatcttaagagaggcatgtgtcacacaggtatacccattcatcaaaactcatttcataatacacatgagatttacacattctagtctatacaaattttgccacaaacaaacaaacaaaagaaatgtgaacaaatattgagctctggttaatgacatgcatgttgaagaacttaggggtaaagggaaccgatgtcaccaacttactttgaagggcatcagaaaataataggggttggcgggtagagaaagaagtaaagtgatacaacaaaatctagagagtgggttcatgagcactcactgtacaattctttcagctttctgtgtatttgaaaaattttaaaatagaatgttagataaaatgttctctcggctgggcacggtggctcacacctgtaatcccagcactttgggaggccgaggtgaacggatcatgagatcaggagcttaagatcaacctggccaagatggtgaaaccctgtctgtactaaaaatacaaaaattagccaggcgcagtggcaggcacctgtaatcccagctactcgggaggctgaggcaggagaatcgcttgaacccgggcggcagaggttgcagtgagccgagattgcgccactgcactccagcctaggcaacatagtgagactctgtctcaaaaaaaaaaaaaaattctctcacagaaaacacaaagcagtgtattatttaagcagttttctgaatcactaacaccactttccaatgaagaaaaaaataccatctgtgggatatggaagtttaaagatactaaacagaacttatacgagtggaaatggcaaaacgttttgctcaaagtcacaatgtgtatggagaggagttggaaatggaatttaggcaggtctcttaattttctaatcaacagactgtcaaagaccagattacctccttaaaagtatgctgaatattctaatagagaaaatgagttaaccttctaaagaaagctcattctcctgttttggtaataaaacatagggaagtatgtattgcttcccatacggaaagatgagctgggtgagaggaggattgggtttttaccactggttggaggataatagattatgaaaaaatatcaacatccagtcataatgaaacatgtaagttgttttattaattaaataggtgaatgctgaaatgtgatattatttgatcacattaaaatgaataatttttttaaaaacataatgacttctcttttgggggtgttggaaactattgcttaagatgaaagcctgaagttaggagaaaagcttgatgtatatctatgcaaaaatatttcagtttatcatcttaggtcacttacaagtcacagaaaagaaactatctagatgtgataataggcctaacatatcattagatgatccatcggtccagcatctcagtcattaactaattaagtgccaaatgtagcaaataaagtactaacaactcaaaagtgttcagcaagagttcattaaagcgaagctaaaggggaccattataattctagcaccacagatttattaccatgtcaccagcatgcaatgcacacaataaaactcattcatcactgtaaatttgcacatcaaatttgatgcatttgttggaatataaatatttttaaaatcatgtagaataaaaagcatttttttctcccttagcacacactgaatttcatatctacaccttgccacttcaacttttacttgatgagtgcagaaaacggaaattaaccccgaaaaacaaagtggcctcactcttatttttacaagcatactccaccatccaactattcaagttaagaaataaaaataaatggaaaacaatttcttgaacagaaactatggctaaaaagcacaattccatacattgcttactgacagaacttttctgtatttcaattcttccttacctccttctcttcagatttaggtgtccctcctacccatgcctaattccctcgctgtactcaatgttccagtctcttccatcttctatgagaagtgattccatcttttacccctcctatgtcttcaatctccgtctacaaccatgtttattttaagaagaaaacaaccaaaaccaaccaaacaaaagacaaaagagtattatttcctttggtcctacaccccacctgcgtcccctgatggaaaccctatgtcttcctcctttgtgggagagtggcttacaccagtgctacttaaaggatggtttgtgtatgagcagcatcagcatcacctgataacttgttagaaatgcagaatctcaggctccactctagagctaatgaatcaaaatctgcattttaaaataagatttttcaggtgattacattttgagaagcaatagtctatacccactatttccacatccacacctcacatacccttctaaaccattacgttttggcttttgccactgaaattacttttgtaggtgatagcagtgaccttaaagttgctacagtattagagagtctaaagtctttatgttttcagatatcccttcagtacctgccaattgacgaaccctctttgaaaccttctcttttgattaatatggaagattccttcttggattttattctgcctatttggccactcctcactctcttaggcccattccttaaatgttgctattccctaggggtctccctttgatctttttgttttcactttacatattctctctggtgagttcatgtatgtatattgcttcatttactatctctaaaataatcagagtaaaatctgtgttttaagctaagaattgtctcttgaactctgtatccatagagccaaacgcctactaaatctctatgaaatagccaacatatccaaactggattacatcatcttcattcttcctctcccctaatcactgatacacatctgttcctctacttagtcactgaaggagaaacatgcaaattatccttcattcttctttcttccttatactttaaccaagaagatgccgagtcacttctccttaatagctcttctggcctctatatcattcatctctctcttccctagattgctttagttaaaagcctcctgatggtctctctagttcagcggaacacaaccttgtctgtgcatttgaatcaagagggctgctttaaaaactacgaatgtctgggccctattaaggctctgatttaactggtttggggtggagtccaagtattggcattttttttaaactccccctagtgattctaacgtgcagccagggatgagaaccactgatttaatgttagccttttgcactccccatccttctttaaaactctagtcagagaagtcttttttttttttttttttaatagggagtctccctctgtcatccaggctgaagtgcagtggcaccatcttggctcactgccacctctgcctcttgggttcaagctattctcctgcctcagcctcctgagtagctgggattacaggcatgcaccaccatgcccagctatttttttgtatttttagtagagatggggtttcatcaagttgaccaggctggtcttgaactcctgacatcaagtggtccacccacctccagagaagtcttctgaagatgaaaatcttggtctttcatcacttattaaatttccttaatgtcatgcctcccaccccacactgctttcaggatagtattaaaactctttacctatcctacaagatcttttataacgtggcctttgtctacttttctagtttcttggcttctgctgcctgttgtgatgcctatactccagctttacagctacacaggaaggagccctaggtatgtacaatgttaccacacacctcacatttgtctaagtatttcacatgtatctcacatgtgtctatgctttctctctgcctacaatgctctctgccttttcagtttgcagcactctgctcaaaagtcactgccactagtcagttttgtcctgataattccctttcaccctatcaaagccttgtttacgtgccattccatgctaccttgtgagtttctcaagtcataaccaagaacttaagtactcatgtaagtgtccttcctacccatgcctaaactgtaaaagtgaaaatcatcacaaatatgcaatatataaacaaaataaacacatacatttagtcaatgctatgaaaattaagtatgtgatcaaatgttttgaagagtgaaaatggggcttttgtattaaggggaagatgaggaaatgaattgatgaagtgtagcctgaactgatttcttcaaatgcttctccagaaaagcaaaaagaggaataataaaaaaaaagatcaatgaattctggttcatttaacatacatactatattattaagacaaacacaggatcagtgaaaataaaatatattttagactaaaatgctggtagaaaaaccaaaaaggaaggagtatgaaagacataagttacccttcctaggctccattttcagatatttttgattgtttaaacttcagcaattcatgaatgttatagtaaatgatttgaaaaatggggagataaaagtaattctttcctcgttccaataatccccattcaagtaacaaaacagcttaatacaaaatatgtaaatttatttttaatttttttctgatgacttatcctaaaaatctacaaaatatgtaaatgaacttttaaaattagtataggaactcttacaatagtacagcagctccttaaatgcaatgcttgggtttatgggaaacaaaaaacactctgtcaattgctcccactgttttcatttacctcctggaaaatcataactatacatccagagaagaaagacctggagagagacaataccttggtgaaacatatggctacgaaatacaggaacagaatagtataatcaccttaattttaaagggaaattctcctgaaacagaattcccatagtaaaaggaaaaaaaattgaggaatttaaaataaggtaatccatgtgaacagtgctttgtaaactgcaaaactgtcagcaaataataaggtatgattgttattttctttaaaataagatacagaatagcattttgcctatactatttgcagccaagggaagatcctatccttttaaaacatataaaactaatgctttttaacccaaacaaaaagacacacatacgttgccagaacttggtctcaagcaagactatatttttctaagttctttaataaataaagagccatttggtcattcaatactgatttgtctttatatatttgttaattatttgttcctttatgtatgcattcatcacaaacttttttataatctcttatataactgagattgagttaggatgtatacaaaatcaaagctaaaaaagaagtaataaacattctgtaagtaaattacataattgagtattcacatgcctttggaatctatgctttcacgatagactccacttattgaatgcatcactaattaaaaggaaaaactaaaaaagaaaattttcatagctcccagtggccttgtgagttatggtaaagattttggtcttcaacctcagtgcaatgggaatccactgaaaggtttaaagcagggaagtgacaccgtctaatctgggcttgaaaacattagtcatgttgctaattggagagtagattggaggggagggcaaaaaagatgcagaaaaacagagtaagatgttagcataggagtccaggcacagcctgatggtgggtggtagatggaaagataagaaaagattagtaagatttagaagataaaatgtacaggactttgcccaagttcttccctctgcctagaatgcatcatctggtacatggcaggtgcttcatgaatgcttttgatgggaaatgaacagggttataaaaacctcacaattttttaaggggtcttaggagtcttggccctgccatacttttctctcttgcaggaaaaagatgaaactaatggactgtgaccactgcttttcagcaaagtacacctaggtcactgtgcttcttccacaatacaggctgcatgtcgtgtctgaaaatcattttgcttaaagctgctttgttgggaaatattacttgcttggcttttctagcttgactttgagttatttgagataaataagtaagagagaaagttgaccctttctctatcatagtctaaaaaataaaggttgctgttggaaatcaacacggacccacaatttcttgttgaatgtggaattataattatccctcatgatgaaatgtaatatagacagtttgccatatggaatagatgaaataggtgagaggccagagctgtcagtttgagagctgtcattcatatagtgatgaataactgaagccatgagggtaaagaacaagggcaaagccttgggaatggtctgaagaggcagatcaaatgcatgaaattgaaataagacattcaggaaaggttatattattcttactttcaaggcagaagctctggagataaagcatgacaggtggtcctttgacgaagcaaagtgaacctcttgggtggtcactgatactttaccaaagtgattaggacatggctgacaagagattggatgtaaagaaaatgatagaaatgcttgtagagtttattttagctgttaaaaaaaaaaaaaaaagcaaaaccagacaggaaacttaaggaatatgagctacctcattgtggaagcaaagactcagaagaagtagagaacaagaaagtaggaggttgagtaaaatatcaggtagccaagttagtcaacaaaagtggaagatttccacttaaaatttacaaaaaaaaaatgctaaaagttagaattttggaaaacgactgaacttgaagattgtacatattagccaggcagttactctaaactcatactcttatataattattaaaaggagctcctttactaattaaatctctaacctgattttcttttttccaaatcctgccatctttttttgcttttctatcatttccacaaaaaccactcctctcctctctttcataatctctgagtttatcaacatttttttttggttacgtcagactctagttttcctatattccacggtccatttgaaagcactaacttattacatgtaactagtgccaatggaaaattccagctagcaataaacgcatctatgttagtcactgtaggcagaactaatgttggctccaatgataagaatgctcctatggttttctcttggctggcaagcagttgctatattgctcctgaaaattagaaagagttgtgctgtgaagcagtagaaattacatacactgactaatacgttagctgcaaatttctatatggattctttcaatctgaatacagtttgggtaatagctttgtccttaggtatttttgtacacacagataaagtatgttaaattttcttgagacaggcattagcaagaggttcagaacagaattagcatagttgtgttccaaaacaaaagatagctgatataaacttgccatgctgccagttccaatggtattactgaccttttaatctcgttgtttttttttaaatctttttattttttctctgctaaatctctgcctcttgctgtttaataagctaaccgttatttggaacctaatgaaaggatttttttccctcagtctaaaccttcctaaatagcctcttcattattctatttactttgaacattaaaaaaaccaaagctgaaatagctaatatgagatgttcatgaaaatctccattcagggcgtcatcatcctaattggtttataacctgctgtgctgaatagttcttccactcatcctcattttgttttgttttttaacttaaaaatgaaaagttctaccaaatatcacatgttctcacttacttataagtgggagctaagcactgagcacacatggacataaatacgggaacaatagaccctggggactactagagggaggagggaggggagtgggttaaaaaaacgacctatcagttactatgctcactaacatggcgatgggatccgtactccaaacctcagcatcatgcaatactcccacgtgacaaatctgcacatgcaccttctgtatctaaaagttgaaattaaaaaaaagaaaacttctgtgttgtgaaaaggaaccaacaatgagagaaggatataggattttaaaacatagcttcaacaatgaccccagaaacctcagaggcctttatctaactgtctgactggagaaaattatctacaaggtaccacgtgtttgcaagctttcagttcaccttttaatagccacaatggaactatgaattaaggacactaagcccgaatctccctttaattctatgtggaaggaaaagtaaagaaataaacaatgattgaaaaaaaagacttacataaaagtagatggtaaaaataaaataaaggtcaagaaggtaataaataaatcatatttcctgaatgttgttctaaattgtgttcaaatttatatgttccagacagtagaaacaaaaagcaaatccttaatgatttataaatatgtaaaagcattccatcatttgtgttattactaaaaatagatgtttatatttcagctatcctgaaaaaattagaataatattaagtaggtatatttgcacattgcctttgaaacaccagagctctattttaaaaatgtacttaatttttttctaccctaaacttactgaatcagagtcttttggctcttgaactattgcatgcattctcaacagataatgacaccccaagggagtgaaaatttgttcttgagagataaaaattcttagctatttctgagtcacaatggtttattaccctctgaaagccacaatatacgggcagatctaaagcatgtctgtggtattaaaacacggatggatataaaaggaaaaaaatcaagttcacctcaatttcatgagtgataactgcaaaccactttgatgtatttccttccagttataatttcttttgctggttttctctgttttttacaaaattaggatcctatggcataaataattccatatcctactttttttcctgagcattaatgttgtaataattccctatatcattaaatactatttgaaactacttccattaaacattttaatattcagtggtaagtataaatcaatctataataaactttctccaaaaattaatgttttaatagtattagtattataaaatgcattttagattattaatcactttccagtgataaataaccaaattacaatcttaaatgatagacactaaagtgtttagtgaccaaatttcttactcagtttccatccctgttcaaacaatgccattttatcttctgctttctctctctgctttctttcttgctcttgctctctttcttttgagaagacttttgaaatcaaactttctagaatgtctgcatatgagctagattcctacttttgcagttctaaagagagtaaaatcggctgggcgtggtggctcacacctgtaatcccagctctttgggggaacaaggcagacagatcacttgaattcaggagttcaggaccagcctgaccaacatggtgaagtcccatctctactaaaaatacaaaaattagctgggcatggtggtacatgtctgtagtctcagctactcaggaggctgaggcaggagaatcactcgaaacaggaggtggaggttgcagtgagccgagattgagccactacactctagcctgggtgacagagtgagactctgactcaatcaatcaatcaatcaatcaatcgagtcaaatcaagaaaagagtgcagagtacaaagagtttgagactaagctctaagaactgggtctttaacgaagctgtaccttttattttcacttaattttcaattgattcctttgttgcattgtttatatggcaataatgcttgttcttacacataattaccattttaatttaatctagaaaaaataataatagaatgagaaagaagataaataaaaattttttctttatctgggtcaggaattggttgttattgtacagctctctctctctctctctctctctctgtctgtgtgtgtgtgtgtgtgtgtgtgtgtgtgtggtgtgtcagagagaaatatttgcgtttggggtccttatttcatttaagtttattatgctattttcaattaatagcaagttctttacatttttaaactatattttaagagtgcacatatttcttaagagttctaaatggcatatttctatttctatgtatacatatatgtttctattatatatgtctacttctatgtctatgcacttatctgtatctatctctatctctactttgatatctctttaagtctctctttttatgtacaagttcctagaggctctaagtcctaacattccagaaatttcaaagaaactagaaagaaagattttcttctgcaattacaataggataaaagagattgtggatagtaatagctatctgcaaaaataaactggctgagcctcagatagcctggggagcttgttataaatacagattcccaaggccttcttatatccctattatgtcagaatttcttatgttggaagcaagatgtccgggaatggccagtaatactagaaatctttgtgggaaatgtcgttttgaaagggttttggggatgaagtaacccagatgaatctgggggtaacaggtagcaatgtcattaacataaagctaccaactattaacttatactaacatatctgagttttatattgttctgtgacagataataggagagtgaaggtaaagctgtatatctgtatatggtggtggttgggggaaaacctcttgcagggaatctaaaaggaagccagggagcaaacatgtgctattatgttttttgtaccatctgagatgaattgtctgtttctctgtttctattaatatttttaaggtcatctagaatagtaaagatgggtagtttatgtagcttttctcacttaaggaagcatcctttcataatgctttattacccttctcccaattctatcactttgaacaataatctatcatttggtcttctggatagtcctcactggggaggacaccccgaacacattaccattattgattttcctgccagtcttgttgtaaaataatagtttgaattattatttcttctttcaaatggtttataaaccagtgccttgtgagtttgtgtagcatgaatcagtctcccagagcctgatcatctctaggtaaactactaaaatttagttgttggctatgcaaaactgaggattggacattaaatctacgacaactctgctatatgatatgaactctatcaatgacctctttatgcagtccttcctgaaatgatttatatcatcattttttaaaaataatcattaacctgaagaaagagtatattaagatattccaaatccatgagatacatagcactttttccttgattttacccatattctaaacattcaatattaacaggcattaagaatcaagaactctttgactattgataggtcatactcaatataaaatactgtttgattggctccagaccaaaaaaaaaaaggttttgtaaaattgtgcccttttcatgtctttataaagttcctagagtttatttctgttattctcaaaatgtttcctcaggagaatttagtaatatttagatccacttaaaacaatcactagttaagtacaaattagcttccaaaatcaatctgaaaacatgctgaaaacatacatctgctaaaagatggttttctcttttatgtaccccctcccatctaaaagttattaaggaagagtctgttgctatggaaacactcgatttgacaccatctgtattcaaaattcaattgctgcaagccttcagccaatctccggtttttaattggcaagaccttcccagtatgctctacaaatctttttttttattttttatttttaggaagtcaatctatacagcatattgcaatgtaaagcatcaagaaagttcacaatgcaagcctcattccattatcttaaaatcagacttgtgaagtttcaaagcattacagccttctgataattacttggcatgaggttaatgcctaaaatttattgccaagtttttttttttgcctattggatttcacacgtaaagaaaatactcattgtaagagtgactttagtattaggaagaccctgaaaaagagccttagtgaggaacttatatcacaatacacagtttagaatggaaaacaaatatagaaatcagagttaagaatgcaattttggaatagtcagactgaagttcaatattatttggaatacttgttagctactttatgtaacctttctacatcttcttttcctcatctgtaagagatctattatgaggattttaaagtacgcattttggggactacacatacttatacatatatagtatatacatatactataacggcatttgaaaatctgttaatccacatggtcttgaagcatatttctccagaatatcaagtatctgtatataagtgttgctaaaattcatagaagagaggattacaaaaaactggaattctctgaataattatttttaaataagggaaggatatgactggatattaaagaaatgtaaatatgcttctggcaggaaaatgccaaaaaaatgtatgcacagttgtgggtccaatcacgacattttgatgggatagagaagtaattcgccacaattgagcactgctgtggtttcttgggaggctctgtcaacctactaagttatagttatcctatgggaacagaccccatagctaaagataattagaatgttgccctctggagttctgcaatgtagcaagcttgctttaccataccactgtcctactgaacagccagcctctttgataatccttaagaggtaacattccaactacactgcttattgctccaggttaccacacactttgaaaagctcatgtctttgttaattttatttaatatatttttaatttattcacttaatctagtgaatgatgtaatgattgtaatattttcgttcagtgatgactgtaatattttggttccactaaaaaactgactacattaccttcatgtgtatcctgatatgaatccctttatagtcttcctttccttttttcttaaattcataaaatgtataaattgatgaataatcaggacttatgctgtgtaagaataaagacaactttatctgcctttggttctccctttaaatctgttcaagtaggttgttctgttctgttcttgggtgaaaatatgggtaagtttcatgtcttttctggtcatcattaaggaaacaaagtcctgctccatatcgagacattaaaattagaatatccagctcaatatattaatcaatacttcaatctgaactcacatatatgatttcttcctcaattagaagaggatggaagtggacaggtcctttactacctggggtagtgggcatggtgggcttcctctttctgtcttgctagtcttctctaccattcaccagctgctatttctcaccctaacaagggttaatgggagtggaagaagaagaaggggtgcagaaaattcttacttcactcagtactgtcactgttagagtgtgactttgtgctttctaatgtcaaatatcacttctggggtttcacggagctgaaatgtatttctcccagttttaagatccagcctctgatctacttcttctatgatatgttccacaattacttcagtagacagtcagtcaacacaaactcatctgaacctactttgtgccaaacactgatctaggttctggaaaatctatgatgaaacaagacacagtccctgctctcatgcagccaaatatttttctcctttgtactttcatttttctttgcttgtacctctaatttatgctttatatccaagttattgttggtacacatttgtctttccctagattatcaacttctttagaaaatgattaacattttactcacttttataaatcccttttccaatggtcactaaagtattattaaatgaagtaatgaacaatgaataaacggatggatgtacagagcgataaatggataaatgaacaaaattataccttcatacattgttcataaaatattgtttatattactcctatgacacatatatcctatctaatattatactaattttactttttctacctaataataaacactgtaatgaaagaggctgtatcatggtttccttggaacaccacataattcctagccccaataccttgcacactgtaagcacataatcaacatttgatgaatgtgtgaatatacttttcagtattttaaacttatatttttccttcacataatttaaatactaatgcaaattattaagtataaaaattagggcaagttgcaaatataattcagtcacagcctccgggaaatgaataaaataatctcactctaggttgatttctttgtgtaaattagatccttactaaatatttgcagacttacacatttataaaaaaaagtcatcagtctcatctattctgtctctattagaaaagggtcaatctatgtttaatttgctgccataagcttgaaggtgaaaatttatttaggaagcatttgatgactgttttctaggtactgttcttaatctaggtatgttaagggatggtgcctatccttaagttgctcacaacttatatgagagataaatttggaatattcactgctgtacatattgaaggatttattatatttataattaaattctaccaaatcacatatggacataatttaatcttcttgtgttattagcacagtgcactgatatactgaagaatctaatttttcaatgaaataaggatctgtccaatttagcatactaaaatagaataacaattttattaattttcatttcaaatcagcattattatattatcttaagattccctttatttgtattccttaaggatgccaattctggttttacaaaatcaactttatattcaatacttttttgtctgaactagacaactgtatacatatgccaagtattttagaggatgaaattttcaattggaaatctgactcctatactcatgatgaagactgttacataatttctatgtcaaaaacatatttaaagtttacctgttttgaatggccatatagcttgttgacgtatatatttagaatcaggacacaaaaataatgaaatgatacaattaaatcaaaatgtaaacaaaatattatcaatattattaaattaaggaactccgaagtgccctatcgtagattttggtacttactgatgcaaagtattatggacagcctggttaagtcctaaaatttgtaaaattcgttacctacttaatgaagtgtaaagtcaatgaatgtgctgctttagtgatcacaacacattctgttagttgccacatgttgatatttattctacttctcctagggacaacaggttacttagtcaaacactttatatgtaacaggttacttagtcatacactttgtttatataatgcaaattctcattcccattttgtcttaagttataacataacattttaatgagttctctgtaccctctcaaaaaacatcatggtaataagaaaaagaaagttttattaaaaaaccctaatccaaattcctgctttcaagattgggggttggtggggggggagctgcgaaactgaacttcttaagattaagagctggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagccgagatcccgccactgcactccagcctgggcgacagagcgaaactccgtctcaaaaaaaaaaaaaaaaaaaaattaagagctttctatatacatttcatttccattttgctcaaatcagcagatcctccaaaagtaaactgaggaacatttcaaatggcctagtatgttgtattctgcaaggatgaggtatgtgaactggaatcagaccaaggtgcttttaaaatctgttatatgtttatgagagattgtactaaaaggactctcaatcccttaagactgaaaattcactacccattgcaaagtctgggtctgtttgctttgggtttcttctggctttttgtttgcttttcaaacaaggcgttttattaacctctttagggtaattccagtgatgactcatggtcatggagatgatgatggcagcttgtagcctacactagctgccagctcccctgcgagacagtccaatcaatcagtaagtatttatggcattcccgttattttcagaacaagatgttagaattaaaataattcaaatataaaggagtaaccgtttgatgcttactgtccatcagggaggcgaaacatatactacatggagaatgtcctcagagagacacaacaacgttgaaattcctaatctatggcatttgtaacttacagatgtggcaacatgagaaagcaacttgccctcccatctccgtatctctagctgaaccaccagttctcccacttttcctactcgaatggtgtttattttttaaaaacatgtgttagcggccaggagccgtggctcacgcctgtaatcccagcactttgggaggccgaggcgggtggatcacctgaggttgggagctcgagaccagcctgaccaacatggagaaactctgtctctactaaaaatacaaaattagccgggcatggtggcacgtgtctgtaatcccagctactcagatggctgaggcaggagaatcgcttgaacccaggaggcggaggttgctgtgagccaagatcgcaccattgcactccagcctgggcaacaagagcaaaactccatctcaacaaaacaaaacaaaacaaaacaaaacaaacaaaaacaaaacatatgttagccttttatctttctaaaacgggctaaacattattttgcttaaaggcatagaaattaatgcctctgagaaattttaagtcccatgagtcaataaatacccaatatgtttgaacttaattgaaataaactatcacaaattgatagtttatatatcagtcgtatatataaaattgacatataagcatgtactttataactatctacatgcatgagtatataagaatacacacacacacacacacacacacacacacatatatatatatatatacacatatatttaaactttcaataactgactccaaatgtagcctcctttcagcataggtttggggaaagaatacccatctaacacctatttttagaatcagaggagttggattaaatcctggttccgctatctgtgtgatcttatgcaaaatattaatatctttgatagttggttctctcatttacttaataaggacaatatctaccatagggactgttgtgaaaataaaatccacttatatatgtataagagttcctcatccaattcgtataaagcacagcacaaatctaaagtattactcttttatgagatactttaaaatctgaataaagttagattttatttgtcccataaagaagtgaaaattttgacagtttcaaattgtctgaaatgtttcatattctggagttccctggaacatgtttttagttaccaaaataccaagctactgaagggaaacgtgggcattttggttgccctgccagacattaagaaaaaaatgaatcccattctatttattgctatgtctcttaaagtacgtttggcatggtacccaacattgagagacacataacctgctgtcctaaaactctgagcaatttacaaattcttgtaatcatagaaagaattccccattttacatcccaaaaggactgtgccttctcctcttagtggctcctacaagggattagactaaaccaaatccttcatgaggaacaggtaaagtgccattgctttaaaatgccaacgtgagcctatatattcctgtgctgttcatattaccttatcgttctgcacaattacacttgatgttcacattttcaggttgactgggttttatcacttcatggcacacttttctgtttaattacagagaaaggtgttttcccctcattcttattctgtgcatttgagacttgattttatcttttcaaacattctgttgtttgaacagacaattttctgataacaagtgaatcaaggactccctgcctttcctttcctcgaccagttctacgtttttctgagagccagctgtggcccagggcaacagttccatggttcctgtatgaaagagaaaaatctgactccaattgtcaggcttattgtatctaccactgccttgtatcctttgtaggggacccccaatggctttactcctatgacccagggttagacttagagatggtaataagccaaaccatgcagtaattggaaacactgaaaatagaaaattctgtatacattttgctttatcttaatattgaaagaaaatatcagagcatttcatttattcattcagagaatcttgatggaaaacctatttttttcaaggccctcgactggaatttaagagaagcaacactgtcaggaaagacaaatttctcgagcaagttctaaaaattctgtgcatagacattagaacagttaccaatattcgtgcacccattttctagatgtgaaaatttttttactcttatagctagcagggcactatcattgtcaacccttgagaaggcctagtggaactctcaataatgaggatagttgattgttatggactgaatgctggcatcccccccgccggctaaaatttgtatgttgaagtgctaacccccaatggatatttggaggtggggcctttgagaaataataagggttagatgaggtcataggttgaggcctccataattggattagtgtccttttaagaagagcaagaagagagactagagtacctctctgcaccacctctctccccaacatacgaggatacagcaagaagaaggttctcaccaggaaccacatctgtcagcaccatgatcttgtacttctcaacctccagaaccgtgaaaaacaactgcctgttgtttaagccacccagtctatggcattattttatagcagcctgagcttactaagacattaatatttgtatagtgagtagccatttgaaaaggacttttccatgcgtcatttcattgaatcctaacaccaaactagtatggaagttatcaggatcccagttttacagatgagaaaattaactgttggagagattaaataatttgccatgggtcccactgtcactaagggggcagagccagtgcttggaccaagtgctcttattttagattcagtgctgttactactatattactaaagaaataaaggccaaagaatctccaggataaaggtagaacctgtcaaacggataaaccaacatcagcaaccatttgtttcctgacttctagttttatatgagaaaaaagctcctgtttgttttagccactgaagtaatatagtttattaccttcaactaacaagagtcctaatggttacccctcagtccagtctttttgtgtaatcaggtagatagtatagctttcctctaatccagaaatcaagaatggggattaaggaaattaaggaatgaaattaaagaaggacattcttatgtatttatctcactaacataaaagtaataatcgcaattgctttcatcaccattgttataattatctcataaccaactattagcttcctaggtctttttgttaggcctccaaaattcaaaagctttctttacaatacccatattttccatgtggagccaggctgagtggacctgagataattatcatcatgtcccggagctataaagttttggtgggttcttgtttctttcaagaaacaaaaacacatgttattctgcacgtgtttcctgtacacatgtaggataaaggacatgtacaagtagtctgcaacttttagggcaaagagtatgattgacatttgtgggagtgtctaatggggatattcaaagcaacatgggatcatgtttcagaaaactcagggcaaaactcataggttgcttgtcctggggtaagccagccaccacatcataagaacactcaagtagtcccatggaggaactcgtttagagggaaaccaactagacagcaccaactcacaagctatacaagtaactcactgtgaaagtgaatccttcagccccagtcaagccatcatatgactgcagcctaattgacatctgagtgcaacatcatgagtgatcgtgagacagaacccctcaaccaagcaatgcatgaatcctgacctacagaacctatgagtgataataaatgattattgctactttaggacactaagtttggggtgattgttttacagtaacaggtaactattcaaactctttcctgacaaaagtagaacaagctcggctttccccttttcatgtagaaaggtcacaatctattaatccttcctacttactttataaatgttttacttaagacaagtacaacagaataaagacaggtggcaagcaattttcaaatcatgtataagtaaattttggtaaagaaagaagtagtaggtacaaaataataatccctacaattttctataacttgagagctgagagcattttttaggaacagtccatggcacgtgtttaacccttggcttagttttatctaaaatgcatgatgccatcagggagtaatattcctatttatgcccacaggtaccaaaatataacagaaattcaagactttagttacaatgaccctgtaggtcataagataaaaatgctagcctataaacatgtagagtatctctttctgggctcatctctgtttgtatttgtcttattagctcactttgtctgagtataaaattctttaatatatttactcataatcatctttatcacaaaaaaggaagaaaaactattttctttaattggtttatttatttaatagttttgtttattatgtttaattttcaaggtggatgaataaaacatttgttaacccagatctttccccttaaaaagaaacataatgaagacaaaaacaattagtagaaaacactatttatgttcataattatggtacatcactttaataaaaaatatttttcctattataaactcacttgaaagatttataattaaatataatcgcaacaggtaatttggattttaaatcctattcaaatatgttttgatattaatcctcttaatttaaaaatgaaatacatttatgaaaaatggaaaacattcatttcatgataggtaattagtattaatttaacacaacgtataggaagaaaaaacatacttgttttttatatatcagtttttatatacaagttacaattactctgatagaactctgaaattcattaagatattaaagaccatttctattatttaacgtatatttccaggtaccttattaactaggtactactaaaaaaataaaagaaccacgagatttatatgtgaagaaacacatgacattatgaacctcatgatgatggctgatgatggtaaattttatgtgttaacttggctgggctatggttcccagttgtttggtcaaacaccaatctagatgttgctgtgaaggtattttttagatgtgattaacatttcaatcagcagactttgagtaaagcagattaccctccacaatgtgggtgggccttctccaatcaattttgaagtccttaagagaaaagactgaagtccccagaaaaggaaggaattctgctatcggattacctttggactcaagattgcaacatcaactcttcccttggtctccatcctgccaggcttttggattttacagatttttgacttttcagctcccacaatcatatgagttaatggcttaaaatcaatctctctctctctctctctctctctctctgtatgtgtgtatatatataatattattatatatattagtattattaccaatctctctctctctctcactctctctctctctctctctctctctctctctctatatatatatatatatatatatatatctcctaattattagatacaacagaagatagatggaaagagacagcagcattctaaactctaatgataatggtgaattgataatacaggtgaaatattggactgtgagttttcagatgatgaaaacctagataaatgttctcaggcccaaggactgattaatgcacaatatatttctaatgacagaaaggaaatatgatattttaatccacttaattattcaacaggaagaacttcaccacataatattagctgtaagaattttaacaatcctgttttgctaaaggatgtgtgacagatattatgtcatttatgatgtttgtgcaccaaaatttatttgatacaaaaagtaagttgtatttcttttttattatttatttatttatttatttacgatggagtttcactcttgttgcccaggttagagtgcaatggcgtgatctcggctcagtgcaacctccgcctcccgggttcaagcaattctcctgcctcagcctcccgagtagctgggattacaggtgcccgccaccatgcctggctaatttttttgtatttttagtagagatggggcttcaccatgttagccaggctggtttcgaactcctgacctcaggtgatccatcgcttcagcctcccaaagtgctggaattacaggagtgagccactgtgcccagcctgtatttcaattcttattaaaatttctcataagattgtctttcactatctctttatacttccataagaatttgtagagtaacttagacatatacaaaataaaaagctaaagggttcattagacctacaaggcaaacagtaatggctaatttccctggtatactgagggctgcatcagaaacctggtctacctaaacacaacaatctttaatcctcagctaaagagtttctatactttattcatggtatcattaagaaccaggatgaaacttatgttacttgaatggttgtacagcagcagaaaaaggaaaccatacagtgtagcatctataaattcattatttaggctgggcgcggtggctcaggtctgtaatcccagcactttgggaggccgaggcgggtggatcacctgaagtcaagagtttgagaccagcctggccaacatgacgaaaccccgtccctactaaaaatacaaaaaaattagctgggcatgatggtgggagcctgtaatgccagctactcggtaggctgaggcaagagaatagcttgaatctgggaggcggagttgcagtgagcaaagatggcaccactgcactccagcctgggcaatggagcaggactctgtctcaaaaaaaaaattattattcagtgtgtgtctaaatgcttctatattgtaagttggcagggttgggggttgtgtggggggtgggtggtgctacctcttctcaaattccttaaatgtaaaccaacttctaggctttttcctaggttcacttttctttgcaccaggtaccctctctctgtgcaagctcagacattccaggtaacttttgaattcttgtccaaaagtaacatcactcctgcaatctctatgttttcaaccatttctttaaaatctcagtatggtcatctagcttcatgttaagcacattactttgtctcccataatcaactccttatcctgagtttgtctctggttatgacattaatcttccaaagaattcaatctccaactcttagaggcaggccttctcttagattgacagttttatatatgcaatcaatgtcaaaatcctgttaattctagctccaccttatgtctcaatttcacttctttctttttactccatggtcactgctccagcttgggctctcttgccttctaactggtcttactgacttcatttactcccttatcctccacaacacacacacacacacacacacacacacacacacacacacacacactcccatgctgatattcgtcttccaccccactgttaacaggtctaattatgtattctcctgtcatcaattcctgaaatacccttccctctccagcttccttctgcttttcaaagtcttattcatgaccaggtcaaattcagcctcctcctggaagcattccactaagccctcatttaaaactcctcctctagttttctctcaacattttgtaatactgctctactgaagcacctatcctaaactgccttgcctaaatatacttgtccaaatacccacatttgattgtgagctctttaaagacaaaggctgaatcttacttttttcctgtatcccctctaccatctctgatattagatagcacagagtaggcattcaaacgttcgctgaactgaactgaactctttggttgccagcggcatcctagtggatgtgaattttgagagctgcttgtagctataacaggttgacagcaggtgctagatgtcaaaagaaggaaatttatatggttgactccacttcttctaaaataagcaaccatctaatagacaatacctgagaggaagatactggctggcatttcattagcaacagagatttcatacaaatgtggagaacaacagagcctttttatttcgccatgaaggatttcatagatttggttgcagcaatgaatgatgggttgacaaagctgctataaaactgtcagttaattcaaaaatcgtgtgagagatgtttttttttattctcatacagaagaacattctccccttctatggccctgtataccagttctttatgcaatataatgtgaattccttttcttaaaatttataagctatcactaaatttctctaagaattctggactgggttgaaaaatccttagctgaaaaaataattccaaaataaacgactccctcttaaaacttggaattctgtttcagaagtccttcccttggtttagctaataaaaggccacattatacacccttcatattctcccatctccagttctctctgtaccaaatccatctcaccataacaatatgtaccatttaatgagcatctaatatgtgccacatatttactttagaaacaccaattattttactttcttaatcaccctaccagcataagtactattattagccccacatgacagatgagagaaccacagtttaggaaagagaattaacttggctaaggttacacagctaatagatcattggggtccactagtctgtacatctccaacacatgtaaaagacaatcctttgattagacactcaaatacacagaagtcaaaagtataaacaggagcagcaaaaatgtatatccagactataattacctgaggttagtcctaatattttaagttgtcagataaatataccttcctatttttctgactaaccagccttttccatttgatgtgcctcgggctttaaaatcatatagacgtgggcttgaattctacttcctcacttgtcatcttcctaagaccctagacaagttacgttagctctccgagtctcggttttctgtctctaaaatgggagtagtaattttatctacctattaaatttatagataataaaaattttgcagtatttcccacaaaaggctttcctgaatatttgtttaattctatttatagatcttattccatcttttccaagcaaccttctcctgtcggtcttttaaatctctccttttggggtggtggtggggggcgaaataactaaacagctaccaaaaagctcattaagtattttgcattaagccttcaaagcaccccaatagattataattaaaataacaaatgctaacattcattcagcttttactatggccctgatctaagggctctacattaattatttcatctaatcctcccaacccatgagatagttataagtgagcctattttacagagaaggaaactaagagcagatagtttactgagattagtcatttgctcaaggccacaaagctaacaagtggccagtctaggcagcctgccttttaaagtaatgcatgctattgctgtatagccccgaaatggtagtggtgggggttacggagggagaagctacagaaacaaggctcttaaatccaaatgttacaggaacgacattcaccaatattgtttgtgaaataaacagaatgataaaaggaagcagttttatctttccaaatcctcttcactgctatgcaaggtattatggtattatgccttgcagtattaacagacacgaacaagagtttcatgtaattcagacgcctccaaggaagaaaatttaaattcttctaatcttatctgcttttggtcccctgacccagcccttttgcagaagaaaatggccaggaatgattgacaaattcagacaccaaagagttaaagaaaaatgagcaattcgaatattagaaagagggagaatttttcatttgatctgatttagacaaaatttactctcttacctagattattactgcatgatttccatcaatataattacctgaatacaacagataccacggtaatagtttcatatagtaaaacatggtggtggcttgcacacccaattacttgaagtttaacatgaatatttctagtagacataaatagctttgtactgaacttttctcttgatagactgcaataactatgtatagattttcccaactgttcaaagttatgaaatgggatttaccagagaaagaaaaatgtttcaatatagtattacatacatatattaactattttttctttatttagctgatttctttttgagcatttctagaagtttcatggcaataaaaaggaagaccaaaatcatcaaatgagaaaatacaattttatgagcaagtattttatttctgtccttttcctgaaaaccaaatctttactaagaaaaattctattttgaacacgatcgaaaagtttatgagtattgaatttccatcccattttatagatttcaaagggagagataaactgaagtgtagcagggctgcaaatgacattgtttagataaacatatcttgtcagaattatcctggtaccatttagaggctccaggcatatttggaactaagattccagcttagactcttaataagcgctatgacacatctcgacagacacttgcttttaagaaaatgctttcttggaccatttggattacagcctttccactaggctgcaaatattcataaaggtattcattcctaaaagacaaaagcttagaaaagaagaactattcaaatcactgaatattggcagagagatacaaacttgccctccggtcattcaattttaatctctatcatgaaaaagtcaatgcaatatgaaaaaaaaatgcaggggataatggaaaatgttcagacaatgttgaacaaatactgtataatacattcatattgtcttcctcttagggaaaaaattgaagtgatttttcattagtaaaataacaaatgactctctgtatagtatgttcagatttgcataaacctcactgccaaatttccatatttctcaggcaagaaactgatcacttacctgtgtaatgggaattcagtctcatattgagtaaatcactcactaagattcactcttttgggtcagtgtgttgcaacttgttggagaaccctcaaggttccagtatggtggaggaatgctctgctaaatcaattgtatggctatcttaccaaatctgttcctcttcctaggctcaacagtgtacactatttccctaattccctcgcagttaggtgtgaccatgtgacaagatccatccaacagaatatgaacaaaattaacacacaccatttccaggcgtggctcatgacaaattttcatgagtaatactcattcttcatctgcccattaaatgcatatgagtcttatgctctggacacaaaagatggaaggagcttgggttcctgaatgacttcatagagggctgcttattttggactgcactaaaataagaagtaaatttctgctgtagtaagcctccaagatttgggagattacctgttatagtggctagtgttactgaaataatacattagcatacatccacattcattgtttaagcaacaataaagagttaaactttcaaaaccaagaacagcctattttaattagcaatcactacaactgaaagaagacatgtctttaggaagtgaatcaaaacatacataatttcagacaaaagaagtatttagtcttagtacaatgattaaggtcattaacaaaagcaacaaaacaagatgggaaatggtaaacatactagaaagagcgcagattttcaagtcagaaagagacatttacaaattccaagctctgttctttgcttgtttgtaaacgacgcagtctcgctctgtcgcccaggctggagtgcagtggcgcaatctcggctcactgcaagctccgcctcccgggttcacgccattctcctgcctcagcctcccaagtagctgggactacaggcgcccgccaccacgcccggctaatttttttttgtatttttagtagagacggggtttcaccgtgttagccaggatggtctcgatctcctgacctcgtgatccgcccgcctcggcctccccaagtgctgggattacaggcgtgagccaccgcgcccggccgagtaactgttcttggaacctgttttctcgtctataaaatggggattataaaatatagctcacaagattctgtaaagattttgtacacacacacagaaacacacagaaacacacacatgtgcacacaccatctaatgcttatgaggtactgaataaatactagctattatcaataagtacttacccaatatgtggaagtatgactaataatattttaaaatattaaccttttactctggttactctttcactttccccaacatattgacaactagtcatttccttagggaagggttaacatagcagaatataaattatgaagatatagactctcatggtttccgagtttgaaaagtctaagcctggtaaaagacaaaagatttcaaagagaaaaaaaaagatggctgaaaggttttcctccttcctgcactacaaaggattcttcgggttgtgggaaggaaaatgaggggatattgcagaggaagcaagaaaattcaataccagtgtgtgtccctggagggaaggaaggtagagagaagtgaagaaaccgagagagatctgagagaacctgaaagcagagctgacttggacctcatttctgaggagaatctctgagggaaaccgggtggcgagtttcccctactccttcgtctgtcactcttcctgaccccatggaaactcactgacacaacacacaatcactgcgaatcactctccccattaaatggataggagtgtatgtcagaagaaaagaatatgcacagcgtctagtcagatgggtcttaccaaagttcctgcccaccctactacggcataaggtacagtacgatgatttttgatattacaaaatgggggcatcaaagtagcggagagatatccagatctgaaagtcactgcacatgggaatgaaagatggcccaggaagaagccactgcctgcttggaccaacagccaaggatatgagggagagactggcatctccatggatgccagcccagatgacaactaaagaacaaatgttctgccacaaatgttctgccacactgtggtcaccacacccatcaatgcatgctttgcaactatataagccctgaattgatttaaaaatgtatttcttctattcaatggaattacattcatttattaaaaggtaacattatggactgaaaatctcagcacaattgttatcatttacaattatttcacattatttttataaatgtgagggggatatatgaacttaagtttttattgaaacttgtcatgcatcttgctttgtgtgtcccatgcttgttaaaaaacttacttcgatccgtaatgattgttctagcctcttgattgctggtcttgtttttcaaattttgggcagcggtaatgagttcttccaactggggacgcctctgttccaaatcctgcattgttgcctgtaagaacaaatatcccttagtatcagggttcttcagcgttgtgtattccttttacataatacaaagtaaagtacaattgtgagaccagccaaaacacttttagaaataaaaaagatgttactgtataagggtttatagaaaacaatttaacaggaaatatgtttcattcttagatatcaaaaatatttcaaatgaaaatcttgactatagattttcttcatttaaaggctcaaatggagacattccggagtacctcggattacttaaaccactgtctgaatgccttgagtaagaaatgttattctgaattacgacaatgtatttaaaagatagataactatttatacttataatatcattctgtgtgacgtcaaaattaaggtatatttattttaaaaacagaaaaagcacagaaccgatttaagagatattacttatttaacttcattgtacccctgagatttctcacctgtcaaatgaaaaggtgaagtagacgagctaaatcagcttttctcctaagctgcctgtccgtaagaatcaccaaacctttttgcctccctccagaactaatgaatatgtagtggaaagggctgcaaatcttgcattttaaataaattatctaattaacttttatgatttaggcaagtttggagagcatcagattacaggttagtattcctattcccctgtattataaatgactttaatatagcactattttaaataaaaatacaaatataataaagttaacaatttttaatttataggtagtaatgtaaatcattaagatattcttccctttcttcagtgtctattttctctgtcatcttagtctctctagatttaaggaccacaatctcagaggtatttatgaagaaatttatgaaaaaaaggcatctgactagctctggttctaaaactcagtaaattttattttaattggggaaaatacaagtaatatttactgttagtttataagcaatatgtgacagatgttttatctatattttctcatttttttcttataataaccacactagtaaacaagccagcaagtttgtataattttaaatatgatgttctaccacatgaggccaatgaagatgaagagatgaaagtggtagatagtaatgtatctgaaacttatatgaaacttagttatttactctgtactttgactcctgctgattttctaacgaattttggttttggaaaggccaaattttgatcattctgtagtgtttcttctgtgaagaggtagggagacaggctttgtgatttaaactcaattgcttttggtaatagtaaaataatgcaaaaaacttttccaaacattgtacatctactttaggcactttctcctctctgtattgaaaaattggaggggctaacttttaacaaattttccacatttgtaagctgtgattgctcagaaaaaaaatccaattttcaggtttctaacttttatggtttctttacacaacagagtgtttgaaatatggaacaaattgccaaagacagctattgaagtaagtggcataagtcagctggagagtactgaacaaattttaaagtaggaaccatatagtagcaggtagattttatgaaataagatgttttccagtgttagaatgtgaaactctggtcatctgtgacatgggaagctgaaaggttgctttggaattgcctaccctaaaatgtttgaatatgttcaatagaatttttaaaacggacttacccagaaacctcagatgaagtcaaattttcacctcaaagttaacagagaactttaaatacacagggctggcaaaatacataaattcatttactcatccattcattttaataaatatttttcagcactaggcactattctagggactatgcatgtggcagtggacaaatatattcggtatagtgtgtaactcacatgaaaaatcgtgcttttcgatacttggaaatttttatataacaaagattatctttattgggttgttcttcttttaattcactctcacataaccagattttttttgcttctcagttttagatacattattcactgtttgctatacttttttccttcttttaagatttcaaagttcatttaagaagtatgttgtaaaagtaagttgatcaactttaatctgaaccttaccaggctctaaattaaacctgaccacaatgaacagcttttattgctgaaattagcaagcatgtcaacttagactcaaaacaagccattttcctctctaatgaacaaaataggtctcagggtattgtgaaacctgttctctagttgggtgattctctaattctgctgacagacacatgctttgtaagcacctgagaagattattaatgagatcctttgaagcagcctccttaaaaatctaaggaggttcacaactgcagtacaactatgcatttctaaaatatttcaaaacaaaatttcaactttttatcccactctatggtcaacacatacaaacattcatttcaacaaagaagctgtaaaatgataatgtatattgctatgggatttatcatacactaataggctctttacttagtggtcttttagtatagcagaatgggaattttctcctttgattccctttctagaaataaagagagggatttaatatggcatacgcttcagtattttttcattaagatattataaaaacagtggttaaaagaatttcttgctaataagaacacaagcatatggtgagagtaacgattatttttcatttggtttccttttaagggtattctatttatttgctactatactttctttgacttcaacttagttttataattccagaacttctcaaataaactgaccttcacctctattccttcgagccacccacagatgagaaaacaccttagatctaatcattactcaaactacttgcctccaaaatatccatctataaaattctgttctctgcccccaatctgctacccctaccagatgttactctcccaaacatgctgttcctagtattatcttcatcctcatatgacctctggtccttttctgtttcctcaacctagctttagtcataacaaacaagtagaatgctaattgtgcttatttatttctctgatatgatcccagatatttgtgacacaaataacttaaagcgaacaaaactaaaatcattacatgcttaccagtacctaagcatgataatggatcgtgtctacatggattctatcattctagaggaaacaaaacacaggagaaggaaggaatcaatgctatttctaaggagtcataagtcagctactgggctttactaaaaactgcttaccccttggagatgagaattcatcatggattccactagctgagcaaagatggaggaaaaaaaattcttcaaatacaaagtgaatcagaagtctttaatctcactaagtccccccagagttgagtgaagtggttataaatagcaaccctatgaaataggaagttaaacagtgaaatcatacatattataactagggcattttaggcttttagacaaaattacaattttttattgtattcattaaaatagaattccacctaaataatactcaaataaaaactctatatgttgagttgaatgcttagtatttacatgtctaagaaaagactttgaaaatcaaactggtcatatttttatatttttctataaaaatcaacaatctacatagcataaatgcccatgatgatttttcaaatgttcccattttcagtaaatgaatatgaattaagctgaaatgtaacaatgtagaactgatgctattttatttacaacttcaaaaaattaatataaagaattcagaaggtaaaagagtttacggaaccattttatgtattgaagaaaataagcatagaagtcaggaaggtactaaattgtagcctttctagttaccgaaagggttttactggtgaggatgctgtaatctatctagctttcaaccatctcactgagcatcttcttctggcttctattcttgcattcggctgcctctccaaatagagtggccaaatcgaaaaccatcctcattgtcttccacttacttcctcacttctcatttccattttatactggcttggatattgatattttcctacttggtcaaccttccctacttcttttttgaatgttctactagcacctccatcggtaacttcttaagaatcttcataaccaacttcataaatatcttccaactgcagttagccttttttgttctttattcactgaataaatactttataagatgcattttatttttatataatttcaagcttgcagaatatttgcaagataaagaactcccaggtaacccttgcccggattcaccatttgttaacattttgccacattatttttaattatttatcattttatcattctctctgtgtgtatagatatataactgtatatgtaatgttttatatatatatattttttttctgaatcatttgagaataatttgcagatatcatgcccctttacccttaaatactttaggttttatttcttaatagcaaagacattctcttaaataacctcagctcagtttcaaagtcaggaaatttagcgtggctttagtaccataatcttatccatactctatattcagagtatgacaattaccccattaatgaactttatagctatatttttatttcctggtctggtccagactcacgcattgcttttagttgtcgtatctccttagtcttttttaagttgaaatagttatttgcctttctttgaactttataacacttacagttttgaccaacagaggccaggtattttgtagaatatcccccaaatttgagttatagcaattttttaagtgcttctgttgtgtcactcattgagctaggtgcaggggctgtagcagtgaaggagaaaataattcctgttctcaaagagaaaacaaacgagtagtgatgacaggcaataaaaaagcaattgcaacaacctgaggtattatggtaggggaaacatggagagttatcagagcatatggcaaagatatcacatgaaatataaaggccaaagactgtcttctgaaggaatcaagcttaagtagtcctcagcttttctttatttaaattatacaaaacagttttaaacaccactgctcctcatacccaagtggccaccatgagaatatgcaggccttctattattgggtcttaactgactgaggactcctgttactgcattttgaaatccatgattgcactgcaccaaagccaagcttctcacagacttctcctcacccaatgattgggtgtggtgggaatactaaggcagagagccttccttgggagacatgggacttctttgcctggctctgcctcaatgacttcccaacagctttgccaaaatttccttccactagaccgcacactgggatgcttctgcctagccttctctccctctctcttccttgcagagtcagaattgcatcttgatctaacatctcttgcaccttccttggcttcctccttcttttctttcacatagatatttccactaataaaatattgtcccattttatcctgtctgggtacatataacctcaggccctgactaatacactcacttttgtcctcctagaccctaaacctctcatcagctcttcagttccatgtaacgtgatggttccatgacactactacctgaatgtgtaactgtcaattattgaatattaattagtaacataggtttcttcatgcctcccatgggctggcctcttaagatgcaattcaagtaaatatgtatttttacatactacctctatttagaaatcactaaggtagggtgcatgaccattatttccaaggagcgcagaatttaactggaggaaaataagagtattcagatgtgttacatggtaatggtggagttccattcaacacatgcagctcaagaactgtaggaaactaaagcaagccaccaggaatccttaacagataacaaccactaggtttgctgcaagagatggcaaaaggaactttggggcaagttttcagatgacggaagacagaaagttaagattattccacctctctgagtgagaagtgccctaggtagacaaagacctcaaccaggaccagcttcttgaacgtataacttgtgcagttagttacacaaggatctgcattagaagggattcatacttggtttcatgctctactgttgccatcttgaaattcttaatttttttttaaccaagggccctgcgttttcatttttcactgggctctacagattacgtacctgattgtgacctcaaccctaaggttagtggagaataaaagttatgtatcttggctgaagcactggttaatcgttgatgggaagaacacatttaaacacaaattaaatgacgtcaatcaaatgcctcttgcttaattcctgagaatgcgtttcaaatttctggaaggagcagttatgaagctaaaaaatgtattttgggggaaatctggcctcaggaaaagctgaacaggacagttagaagtggttccaaggtgggactgtcatcactatcaatggttattggagaacaaaagtcactataggaaaaatgaagtagggaaacgacaaagaaagtggtgaatcatctgaggaagaaattggagataaaaaggagaacctgtggcttcagcaacaatgatggctgctgaaatctcaaatgacatttctaggtttagctaagtgttagctgtttccaaggctaggatagacttgggaaatacataagaaacaactaataatttgttttagaaacatttactaaactgcaactatttgccaagcactcagctagtacacatagacaaataaaacttgtcttcttttttcaaggaacttataatctagcaaacaaatactcataaacaattattttttgtgtaataatacaatgggaagtaatgctaacgacaacaacaatagttgtttattgagtgcataccatatgccaaaagagtctatcacagcatactagttaaaagaatgaactctggagtcaggctttcccaatttgcatactggctgccacctattcggtttactattttcagtatgttacttaaatgctgtctgtatcatttccagcactgtgaaatggagatactgagtctctacctctcagattcattatgagaattaatagagttaatatttgtaaggtgtttagaacatttcccatttcatagtaagaacaataaaagttttaaataaaaactatcagtcaatgtaattatcatattactctgtgaggtgggtactaatattgcccctattttactagtaaagaaaatgaatgaaaaagaagttaaacaatttgtctaggatcacatggtaataagtggcagaacttctaacataggtaagttggccccaaagcccacacacttaagaactataatatagcatgatatacttacaaggtactcatgtcatagtataatataaggtagctatatgatagtatgatataatataggaatggataaagggacagggatatgaaacgagaatacaaaaggggaaattaactatttcattcaaggacagattatattctgaatcagtcatggttcttgcaataaatagttcattcaaagtgggatgaggaggctttcctcctcaaggcctgaaaggctaaggggagggtatagttagtagaatctgagaagtggctgcagggacaagacctcttgacaggagctggggctgtgagtaaaggaacctagccatccctcgactcactctcctctcatccattgatctgctgatgcctcccaacacaaggaccaagccaatagacaagcaagcccaatgctactgccatattggtcaacctcctagggtagaacaacaggttagagattggatctgcgaaagtatccagcaacagtataaaaaaaataataataatggcaacaactattgaaacaaatcagtgaaggaaatgaccacatatgggaattctcagcaaagacttcatatcaagtatggcactacagctgaactttggcagatttggctagagaatgagaagagcattataagggaaagacagacatgaacaaaggcatgaacgtaaaataaagcctcaaatgggctggttagagcctggaattctttacaaataatggcaaataagtttaggtagacatagtagaagcagtatatagttggctttttaaaaatcagtttgaggttttgaattttatcacaaggacaactgggaagcagcgaacttgcagaaaaaaactgaggctataggagcaaagctttcagtaatcctgtgcctccatagattttgttctttctggttgggataaatttctcaattcttggtccattcctagaaatacagttaacagatacccatacgtaaaaagtgttgattgaccaaatcactgactacaatgaagggaaacagtggtacaagaaacaagtaattagagacttgtggcagatcaagaatacatacaaatggcaaacaagcatatgaaaaggtgctcaacatcactgaatcattgataaccagagaaatgaaaatcaaaattacaatgacatattacctcactcccgttaaaatggcttatatccaaaagacaggcaataaccaatgttgacaagtatgtgaagaaaaaggaacccttgtatactgttggtggaaatgtaaattagcacaaccactatggagaaccgtttggaggttcctcaaaaaactaaaaatagagctaccatataatatagcattcccgctgctgggtatatacccaaaagaaaataaatcagtatattgaagagatatctgcactcccatgtttattgcagcgctattcacaatagccaagatttggaagcaacctaagtgtccatcagtagatgaatggacaaagaacatgtggtacctatgcacaatggaatactactcagccacaaaaaagaatgagattctgtcatctgcaacaacattgttggaaatggaggtcagtatgctaggtgaaataaatcagacacagaaagacaaacattgcatgttctcacttatttgtgggatttaaaattcaaaacaattgaactcatggacatagagagtagaaggatggttacctgaggatgggaagggtcgtggggaggtgggggtggtgtaggtatagttactgggtacaaaaaattagttagaaagaatgagtaagacctactatttgatagcacaacagggggactataaccaataatgatttaattgtacattttacattaattaaaagagtataattggattgtttggaacataaagaataaatgcttgaggggttgaataccccattttacatgatgtgcttactacacattgcatgcctgtatcaaaacatctcaagtaccaaataaatatatacacctgctaggtactcacaaaacttaaaaatataaaaataaaacaaaaagaaacaagtaattagaatcagaaatgtgtggaaattgctagaacacatgttccttttctaagcagtatttatcagtattataaaaatcactgatcatttggctagctttaaaaataaaaaatatgatagctgtttaagaaatcattattagctattcaaacttaaaaaacaataagacagtcagtgaaatttatttctctatttctttgtagtaatgtttcaatttgttgatattttggggagttaaaaaaactcttaagcctagcactgcatgttctcactcgtaagtgggaattgaacaatgagaacacatggacacagggaggggaacatcacacaccggggcctgtcaaggggtgaggggcaaggggacagagagcattaggacaaatacctaatgcattgggggcttaaaacctggatgttgggttgatgagtatagcaaaccaccatgatacatgtatacctaggtaacaaacctgcacgttctgcacatgtatcccagaacttaaagtaaaattaaaaaactaaaaaataaataaataaatataaaataaataaaataaaaaaagagcatagtaatctcaaaaaaaaaaaaaaaacctcttaagcctaccaaatttggtgacttctttgaaatggtaataatattaatctactattagtgtgttatttttaaaataaattatctccctgtgttgaaaaaaagattaagatggtcctttccaagctattataccacacggaacttaaaggattgatttacttgtcatttactaaaacccttaacatccaaaaatgaaaatgcctttcactttcacaagccagtaagtaaataatgtggtgtaaattgcggatcttgaaatacaatttcaaagtcaagaaaaaaaaagaattttatgctacaatttgttgataatgatttgcaaacgcatttctaaagtgatataaagggcgttgataattttagctattcaacgttagatcttttagttattctacattgttcacatttcttgaaactctattgttctataaatttggcatattaacaaaggataatcaagacaggtttaagaccagtttttatcatgtgcatcagattcgcaggcttttgatattatggcccagtaacataagtgatataattttttctcctacacacattttagaagaaagagagacatgaaacaatatataggactgccttggaatattgtgtgtttggttccagactgctgcaataaagtaaatatcacaataaaatgaggcacacgaatatttttggttccccagtgcattaaatgttatgtttacactctactatcatctgtcaagtgtgcaatagcattgtatctaaaaaatgtacataccttaatttgaaaatacattactcctaaaaaaaatggtaacaatcatctgagcctgcagggagtcataatctttttgctggtacaggctcttgcctcagtgaggatggctgctgattgatcagggtggcggttgctgaaggtcgggatggctgtagcaatttcttaaaataagacaacaacgaagtttgctgcatcgattggctctcctttatagccaatgatttctttgtagcatgtgatgctgtttgatagcattttactcagtagaacttctttcaaaatttgagtcaatcttctcaaaccctgatgctaatttatcaactaagtttatggaatattctaaatcctttgttgtcatttcaacaatgttcacagcatcatcaccaagagtagagtgcatctcatgaaaccacaatctttgctcatccataagcagcaactctggatccgctgaagttttaccttgagattacagctattcagtcacaccttctgactccacttctcattctggttctcatgctatttctaccacatctgcagtgacttcttctactgaagtcttggaccctcaaagtcattgatgagtgttggaattaactacttccaaactcctgataatgttgatattttgacctcctcccctcaatcatgaattttcttcatggcatctggaatggtgaggactttccgttttcagtttactttatccagatccatcagtggactcaccacaatatagcagctatacctttatgaaatgtatgatttaagtaataagacttgaaagttgaagtgacttcttgatccaaggactgcagaatggatgttgtgttagcaggtatgaaaataaaatcattctctttggacatattcctcagggctcttgggtgaccagggacattgtcaaagagcagtaatattttgaaagacacatttttttgagaagtaggtctcaacagagggctcaaaatgttcatcaaaccatgctgtaaagagatgtgcagtcatctagtctttgttgtttgatttacagagcataggcagactagatctagcataacctgaagggccctaggatttttggaatggtaaacgagcactggcttcaactgaaagtcaccagttgcattagcccctcacaagacagtcagcctgtcctttgaacttttgaagccaggcattgacttctctctagctatgaaagtcctagatggcatccttttccaatagaaggctgtttcgtctatattgaaaatgtgttgtttagtattgccacctttattaacttagatgttagtttgatcttctggatagtttgctgcagcttctccatcagcacttgttgctctgccttgcacttttatgttatagagagggcttattcattaaggctcatgaacatacttctgctagcttccaacttttctgctgcagcttcctcacctctctcggcattcacagaattgcagagaattagtcctttgctttagattagccttttgcttaagataatggtgtggctgttttgatcctctatccagaccactaagacattctccatattaaaaataaggccgttccactttcttattcctgtgttcaacagagtagcacttttaattttcttcaagaacgtttcctttgcattcacaacttggccaactggcacaagaggtctggctttcagcctgtcttggcttttgacatgccttcctcaccaatcttaatcatttctgacttttgatttaaagtgacaaacatgtgactcttttttttcccatgaacacttagaggacattgtagggttactgactggcataatttcaatattgttgtgtctcagggaatagggaggcccaaggagaggaagagagatgagggaatggctgatcagtggagtagccagaacacacaaaacattgattgattaagtttgccatcttatgaaaataagtaatgggaaaaggactctgtatttaagacatgatgctgggatggctggttagccatatgcagaagaatgcaactggaccccctccttacaccatatacaaaaattaactcaagatggaataaaggtttaaacattagatctcaaattataagaatcctataagaaagcctaggaaacaccactctggacatcagacttgggaaagaatttataactaagtcctcaaaagcaattataacaaaaccaaaaattgacaagtggaacttaattaaactaaagagctcttcacagtgaaagaatttatcaacagagtaaacagacagtctacagaataagagaatatatttgcaaactatgcatctgacaaaggtctaatattcagaatctatagggaacttaaacaattcaacaagtcaaaaacaaataaccccatcaaaaaaaatgggcaaaagacataaacagacactactcaaaagaagacatacaagtggccaacaaacatgaaaaaatgctccacatcactcaacatcagagaaatgcaaatcaaaaccacaacgagataccgtctcacaccattcatactggctattattaaaaagtcaaaaaaatgacagatgctgctgacgctgtagagaagagggaactctgatacactgttgctgggaatgcaaattagttcagccacagtgaaacagtttgaagatttctcaaaggacttaaaacacaactatcgttcaacctagtgatcccattactgggcatatagcccaaataaaacaaattgctttactaaaaaaccacatgtattctcatcctcatttcagcactattcacaatagcaaaggtatgaagtcagcctaggtgcccatcagtggcagactggagaaagaaaatacggtgcatatacaccatggaatactatgcagccataaaaaagaacaaaatcatgtcctttgcagcaacatggatgcagctggaggccattattctaagtgaattaatgcagaaacacaataccaaataccacgtgttctcatgtggagctaaacagtgcgttgtcatggacataatgatggcaacaatagaaacggaggactactagagtggggagggagggaaacaagggttgaaaaactaactatcggttactatgctcagtacctgggtgacagtatcatttgtactccaaacctcggcatcatgtaatatatcaaggtaataaacctacacatgtactccctgaatctaaaatcaaagttgaaaaaatgtttgtctttttttttttttccacacagggtcttgctctgtcattctggctggagggcactggagtgaacatggcttactgccgccttgacctcctgggctcaagtgatcctcctgtgtcagcctcccatgcagctggcagggctccttacagccatgtgccaccatgcccagttaatttttctacatatatattttaaagacagggtctcactttgtttcccagactggtctcaaacttctgggctaacacgatcctcctgccttggcctcccaaagtgttaggattacaggtgtgagccactgcaccccacaaagtttgccatctcatatgagtgcagttcatgacatctcaaaacaattacaatagtaacatcaaaggtcactgatcacagatcataacaaatataataataataataatgtttgaaatattgagcaaattaccaaaacgtgacacagagacgtaaagcgagcacatgctgttggaaaaattgtgcccgacggacttgctcaatgcagccttgccacaaactttcaatttacaaaaagtgaaatatctgcaaagtgcaataaagtgaaacccaataaaacgagatacgcatgtacatatttggggattattactcctcaattttttcagtattaatttcttgttctaccttgaataacatcattttggaatccttcgaacttccacttatcaagacgaattctcttgtccctattcagaggaatctatacagcaaattgaatcataagtgtactaaaataccaaagcagaagataaattacaagacatgaatagtgaaatgtaactatttgagggcattatttgtaatagtttgcctggtacatactcctcctaattttgcatcctaaagatactatccaaagactgtagaaattccagatacaagaggctagagttgacaggtaattaagctttggtcaatcaaagagctagaaaatatttattgaaataattgtatgcataacacatcacagtagggaatgtgcctcatggatgacatgaaagagactctctagtgaaataattgaacttgtgatgaactttcaatgcagttggggaggtgaccttcaggccagcccatgcatgctcgcacacgcagttacccaataatagaagacaatatgtaaatgacaaacgtaatagtctacagaccacatatcctaccctaatgggattctgagagatgggattttatatgggaccaggttcagggaaggtgccatagaggaacagcaacatgaactgtaacttagaggatgaactcaattaataatgacctaatgggagaaggaatttcaggacaaggagtagctttaaaactaaagtgtagaagtcagaatacagcagagtggttgagaaagagtgggaagggcagctgtgtaattagttagcagaattacgatggctgtgatcaagttgagaagggaagctggggccagaatgtgagggctcagaacactagatgcccaaataaggacatcatgttgaaggccatgggaaatcatcagaggtttgagagcagaagaatgccacaataaaagtggcatgttagaaatattaacctcgtacaactgcatccaatgtcccttccaagaaagaaatggaaaattaaattgcagtaacccaagaaaagcctcttgtatctcctctttgattaaatgtcctgtcatgaaaacatgtaaaacatttctaatttaccttcatgcatctttttaagaagaatataataactccactgcacacaaggaacataaattcaaccccattgcttgtaaaaactgtcccaaagaattattaaacaaatttgctgattctacttgtaatattatattttactatataggggtaaaaagggattgtagtttcagtttagaaaaaaggtaaacattcagaatgttttgttaaattcttacattcctactctaaaggataaacagagactttcagagtgtgagaagaaattgagatctctctggaaatacaacttcaaggattattatcagtgataagaagtattaacatatgttatgatgtcacattttgtgaatataacttttcaatgcccttaatacgtattgctgcactagacctgatatttttctttgggaaataagtcttcaggtagtactcctatttctaggaaaggagtactggggtattgtgctcatctgttcaaaaataaaagtcaaagctaacaaaacatttgttaaaaatgcattcaaccttttcacgttttaaaaacattttgaagatattattcatttaagtactgaaacaaaaccatgctttttatttctaacggcagccatcaataaactgaggcaaagcaagagatgttaccattcgctgatactacctgtagatgggaagtgaagtgaagaaatgagtgattatctagaggcgattacactcatgaacacagttaatcagaataattcaagccccctaaccctcttctgctgtcttcacatggtagatgtgaaatttgaattatcaaaataattggcacagctgttcaattcatgtttcccatatagggatagaatcaggctcagtttattcagctataaagtggagataattacattcatataaaccactcttgtgtgattaaagcaatgaatctatttataagaattcaaataccttaggtagaaattagtcaaatatggctagtccaggtttctttacagtaacagcaattaagacatatgttatatagaatatatttaatccatgaggtttcagccttctgattttgccaaattctgagtgctacaaagtgaagatacatatggatggtgaacaaccatgtgttcaccttaaacaatgctatattaatggcttggaaatccttgtgagttttacaaataagtgtgaaacaggagtgcatgtgtgtatgtgtgcatgtgtctgtgagcactcacacagacaacatccgaatggagaagagaggtatgaataaatatatatcctaaatttgcatcaaaatggtgtaatggttacctttggacgtacatataaggggaaaaagtgcttaacaactaggtctcattcttcaaaataaacaacatcctttgtacattttctcagcagttgtctgggagatcaacattaatctatttcttctcagaacttatatgactgggaaaaagataaaaatctgcccttgattgggtgctatgtgtttaagctctggtttagctgtaaatcatttgtgaagatcatttcttggtaggtgagtggaattgctattatagagtgttaatatacttgcagtgaagtgttgctgggggtaggaggtgttagacattgatcaggagcttaagagatgagctatttatttttgctgttgtaagagcaaatttctataataaaacaatgattctgcttctctgtcaaaaaacaccattttatgacatgaaagctctcttcagtaaacaaagaacagactgttattggagaacgtaaaaattacaatagaatatatttccctataggagcacagtggcctttaactcagctggaacttacagtatgacagcttttaaaggaagggacatattctatggggaggattttagacatacttgtctattccctaggccgtactaattcttatcatataaaaatgggtctacattagcacatggtgccagtatatcacacacttgcactgcggcatgaaaggagcccagcttgagggggagaactgctttctgtggcatagttccaagcaaacacatggcacaaatgaagccgattctgaggaatatggaaactttatgtactgtttgatagggaaatgtgcacagcttctaaacggtgagcttctagttctgctccaagaacaagtacaatcaattcttaagtggtttctgtaatgttgtgttcctaaccgagctgtttacattatagggaagtgttaagtttaattttctgttttattaggcaggtttctcattatgaacaataatttcaataccttttaagtaatttaaaaataagcagtaatccctgcagaaaggctgcagtaccatttctctagtgattcctttttctgtgttttatttgtataaggtgagcaaaattgcttattctttgttgcctcagagactttagtggcatgaggctaggcagagacaaaaactgataatcataaataaatcaacactattgggtggttccaatatccagtatctcaatgttctctgccctttgtctctttctgctatattaatgatctgtcttaattttacaagttttctgtaagatagtagacagaataggtgttactgaggtgaaggcttcaatccaaactacaaaactaggtagcctagaggcaacagctaattccatgcttttggttcacaaaggaatgctaatacacacaagtaataacaaaacaaactcacagtacatgtgctactgaagaggtgttgggagcattaaatattcgtacaaagggcagcacaaaatgggaggttaaaaaattaagcaacattaggaacctgagagatgcaactaattaaccagtttggccttaataaatatccatgctgtaatattttaatagtaatatctgcccctaatatctatccatttatgtaatattccccattactatctactcaaatgttctgctacactttctcgtaaaggtcagtgactctccactgccttacaattcaaactcctacagcgtagcaattactacaacaagagtaataactagttattgtgcttttcctatgtgctagatattgcacatgggatggatttgatttgtaattatgtgctagatattgtacataggaaaagcacaatatatattaacttacagacaccatttgaggtaggttaataatgaccacccctcaatggttctgtacttacacccttttatagacaaggaaaatgaagcacggaatgaagcataatttgcccaaggtcaccaagctaaaaggtggtgaaggtggaataaaatggcccatatcctccttttccagtgtttttctcttttacatcgtaactacaatttcgtaagcagctataatgtagccgaagctgggctagatgctttatagtcatcatttaatcccaacaacaactctacctagctgggtactatattcatttttttacacatgaggaaataagcacagaaaagattaccaacttccccaaagacagccagccagttaggatcaggatagcatttgtttgtttctttttttaattattttgagattttattattattattattattatactttaagttttagggtacatgtgcacaatgtgcaggttagttacatatgtatacatgtgccatgctggcacgctgcacccactaacccgtcatctagcattaggtatatctcccaatgccatccctcccccctccccccaccccacaacagtccccagagtgtgatgttccccttcctgtgtccatgtgttctcattgttcaattcccacctatgaatgagaatatgcggtgtttggttttttgttcttgcaatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtaaatagtgcctcaataaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaagagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtcttttggctgcataaatgtcttcttttgagaagtgtctgttcatgtccttcgcccacttttggatggggttgtttgtttttttcttgtaaatttgttggagttcattgtagattctggatattagctctttgtcagataagcaggttgcgaaaattttctcccatgttgtaggttgcctgttcactctgatggtagtttcttttgctgtgcagaagctctttagtttagttagatcccatttgtcaattttggcttttgttgcccttgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagtggtagatatgcggcgttacttctgagggctctgttctgttccattgatctatatgtctgttttggtaccagtaccatgctgttttggttactgtagccttgtactatagaagcattccctttgaaaactggcacaagacagggatgccctctctcaccactcctattcaacatagtgttggaagttctggccagggcaatcaggcaggagaaggaaataaagggtattcaattaggagaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacgacagacaaacagagagccaaatcatgagtgaactcccattcacaattgcttcaaagagaataaaatacctaggaatccaacttacaagcgatgtgaaggacctcttcaaggagaactacaaaccactgctcaaggaaataaaagaggacacaaacaaatggaagaacattccgtgctcatgggtaggaagaatcaatatcgtgtaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactaaaggatagcatttgaactcaggtctttctgactcctaagtctagccctgtccacatgtcataaggtctcttcccaagcaactctgcttcctattctaacacttattccttactttcctgcctctgtgactctggttctcatgccaccaaatccatcaacacttccttgcagtcctgtttctaaaatagaattcagtgggttaaacaaatcatgattttaaaaagcagaagggaaaactacacaattggcttgcttctcctcatctttctctaacttcatttccagctggacacttttccctttttgttctgctttattattatttcacacaaatacattcagatttgtcaccttttgttctaatgctggaaatacaaattcatatggctaaaacggagtggaccatgacattgcccccagaccccacttttattccttgtaattaagaaaaaataaaccttaataagaagcttgtattaaaattgtgcaaagttagtcattactaaatgttcatggctgtattagctgcctgtggctgttgtaacaaatgattacagacttaatggcttaaaacaacccaaatttattatcttacaattttggaggtccaaagtccaaaaaatgggtctcacaagctagaaacaatgtgttggcagagcttgcattccctctaagggatgtaggggaggattcttttccatgccttttccagcttttagagcctgcctgcatttcttggctcttggccctgtccttcatcttcaatgccagtagtgtagcatcttccaatctctcttttactctgcttgtatcatcacctccttctctcttaggaggactcttgtgattacattgggcgcactggggtaacccaggctatctctccgtgtcaagatttttaacttaaccacatctgttaatacaaagccttttgccatgtaaggtaacatattcacaggttcctgggattaggatatggacatctttggcgggggaggagtgggcattattaaacctttcacaatggttctgcatttacttagcatgagaagctgtttgtcacaatgtgacatactgacatacttcttcgggtgggttcggtactatgtgtcatcgacaagagttacagtatctcacaatctagaaagcacaggaggcaaaaaagcaaacaaaaaacaaccagtcataccaggctcctgtgtccttgtggcagacatggtttaaccaaaggcctccggaagtgggaaaggtgtattgttgggtctctttcaccctgtaaccaaaagaccatttgaattgaggtggaaactggagttcacaaaagcgttacattaaaaaaataataataaactgtgactccctgaggaaatcacagtgtttctgtttggtgacaagctgctcttcaggaatgaatcctataagaatttcagataaagctcttatcttttggggagtgaaggctgcaggaaaggctagggtattgccttctgggatgcagaaaaaccatcttccccttagctcagctttgttcattcaacttagttcttcccctccacacccactcataaacattaagccttcttcccagctgtcttcctctctctttttcatttttaaacttcatctactttttgaattcttttctctgcaacaactactactaaaatctgaaagcttcttctattgttaccatggagagggcaattttctcaacaagtaaaggaggtggtgcagagggagagggaagaactacatatgaaaattgaaagttagcctctgtgtcttttcaacaacatcaaattaaatcttttcacttccatacacaaaacaacaggaacacacagtgggtggcaaattcagcccagggatgtgaatgaatcagtaggctttgtgataatatgctgggggtgtgagggaggtggcgaggcagcccctcaatcctaaaacagaaaagtaatgaacaatgataactgatatagacaattactctgcagttgtttgaatatatgctgctttctatcattttcaggtaaatgaccttcagaatggcagtagatggatttctaagaaatcatgaaatacaaacatgtagacaaacaaagcaggcagaaggaagtaataagtttaaaaaatgaagtgctataagaactgagagagaaagattatcaatcctccctttttctttcttctattcttctctatacaagttatgaagtggaagaaaatacaaatataaaatcatctgatggtgaaacatcagtgagattttaattatatctagattttttaaatctcaaactaggaaaaatctgctgattcacaaacatgaaaatattttaaaagatcagagatatattaattctcatgttctaattctcctgacatgaaccatatatatgctttattctttctgatgattctgagaaaaatcaaattctgaatttttaaaatgatgatgttgcccaaattgtaataaatcaccatattttccaaagaaaaattctacacaattcctgtacataaattttgtgtggaaaggcttgtatcataagaataatcaaaggaaaagaactgcaaactagtagaagcataaatttaaaatgttgctgatgatgacatcgagtaaagatttgaagtgttaagtagcatgttaaccaactttttctatgatcctcttccccttctcaatacccactctagcttttaaaaacacaatgagattgttttctacagcacaatgatgaacatttcaggtgtataaaaaatataaagaaaagattacaagtgaagtctatggcatggctgtactaatccacacacacgtacgctcggcagtgtaaaagttacctcactgatttgcttgaattaacaatttaaaataaaattttatactgaattaatgtttatttttataaaatagcagtgttattagaaagatttctgacaagtagtgtacgattacaaatatcatctaccttggagttaccatgaaattaggagggtaaaaatagtaaataaagatcctattctagacatctggcctatatgcagacaaccaggcagcacaaactcaagagtccgcttgtaattgcttttgaattcagagaaaattaatggtaagttggttggtttacaacacacaattctcttatttgcaaagcaaaactgaaaaatacagatagatagccaggcagggaaaaagagagagagacagactgactcattaaaagagagagagagagacactgactctgatttataggatacttgcttatctattcctgttagaattttctgcttgccacttcacatagtatcaacaaaacgaatgtattacccccaaattacagactattaaataaagataaaaactaagatgattttcatgagaagtaaacaataagctttttacacagcacaaactgaggatttcattacacaaagttatgggaaaagctacatattgatatctttgttattgtgaatatctcagttattgtgaatctgtaaattccatgccctattacccccatacaagccagggagatgtactcgtataatagcatttcactcatgattgaattgacaccaaatggttgcctctttgcaatatatacaaagaaatttttagttgtgggctttgtgttttgttttgtagttagaccgctaaaaataatcaaatgtctgatatagttaagccataaagatgaaagaagtgtctcacttaaaatatttattaattacatatgtttttatatctataatatacttatattctgatgtgcaggaactcagttacttaagtcaggaattcacgtggggatagagttagaatttaatcagaaaggccagtctcctggggtgggttctaccagcatttgaactattttttatcacagtcaacactagaggccttgctaatgagcaaaatgaatattagaaatgagttttcacttatgagattagtgttacttaagatacatgctttggttaaaatatttgagagcaattcctcatctctagcttgctaggtataaaaatatagtaagttatggaacctgtattctttggaatggtgcccaagatttaatgcctaaactatgctttgtttccacattgaatccgaagattctagttgtctgatgccttctctaaggttaactgcatcctgcctctagattctggaatattctcatgtctcccttgattgaaccttttatacggagtatgacaacacctgagagtgagggtatgggagtgtagctaacctttacctattatactaaagttttgctgtggttatctaccaaaaataacctaatagttggccttgcataatagtgttgatctagggcaattcataacaccacgtaagccacaaattttaaaataacctccactataaggaagtgtaaccaactccttacattcaacaatacatttgactttattcttggagtatattattacatttttctttttatttcctcatggttatatttgttataaagcatggttttataactaggtcgttaaagatctttaaagattgtgttattttttgcatactattactatcatatgaataatttcacaatcttgccttgtctttcatcttgaggcacctattcacataattattttttcacagtccaaacaataaccaggccttgtaatttagttatgaaataaaaaggctggtatttacataatcgtcttatgagttatgcatgtgcaagaaatgttctgcatgtttgtgtgcgtgagagagacacagagagagagcgagagattgagagtaagcccgatcattattgaggggtgtaagaaattactttatggagatgcaaaaacctggggttcagatacgagactgcggtgagatcattgcctcccaccctctgggggctcatctgagctgccaaaatattctcctctctgacatttttatcttggctcttcgacaagttctcagttgcctgctcaagattcatattctctattatttcttccctgggtatctattttcacagaatagttgaagactcataataaagcctattttaatgtatcatttttcctaagcaaatccatttcaatctccactgtttttatttgccaaacatgtcctaaatactaattataaacgcagctcaatgcagtttattatgtttccacgtatttataccatatatgttattcgtgtatgtgtacacacacacacacacacacacacacgcgcatgcacgcgcacatatggtttgttgccaataaacctgtgatagaatctggcacttatcaatggcattgccttgggcaagtcacttaacctctctgagtttctccctttcaaaacaagaaaaacgccagttagcttgtaccacttttgagaggattagaaatattgaatatgatatgcatagcacaatgcctggtatatactagaaattaatgcatggtaagcatcatgaattttatggtagtatatatgacctaacattttgggccaaaaggaagtgtttgaaggcaatttggtcaaagccaaacactgtatgtttaaataatgatggttgggcaacaatgctatgtctttaagcatttctttccatttttcaaaatctgctctttcttattcacaattatttctactatttaatattttaatgggaagagttggataaacctaaatgtgcagcattgggattcttttcatagtgatcacttaaagtttgttttgctttttttttttaccttatatcaagaaataatatataaccaatacataattatatgaaaacatcgatctttaaaatagcataaataacatcaacaatccttccctatgtgtatataaaatattcatagatatatatgtggtgtgtgtttctaaaagtaatatatgtgtgtttgggtatataataaatattgcaacaaaaacaatatcatgtagtacatactggtttgaaggtgctctcctcactatactccaatttacacaccacaatctatttcagcatcccactaaattttgggcaatttaattttttcctgctagtccctatttgaaataatgagcttatctgtagtgaaaagctgtaaatatgctgcctagattcccctttggaaatgaaggacttagttccccagctgctaggagtgctgctggtagacagccttcagctgtcagcccttgtcttagtctgggccgctatagctaaataccttagactgggtaatttataaacaacagaatttattgcttatagttctggaggctgggaattccaagatcaagacatcagcagattcattgtctggtgagggcccactcctgttaaatggcatcttcggtgtgtccttacatggtgggagggcaaggaagctttctggagccgcttttataagggcactgatcctgtttctgaaggcagagcccgcatgacctaatcacccccccaaacccccaccttctaataccatcaccttgagtgttaggtttcaacatacacattttggagggacaaaaacattcagaccatagcagcccccttatggaaattcccgtggctaaagagaatcatcttgctaaagttcgttgccttcctggagtagcccacatccagtgcatgacttgacacggggttataaagatccagtcccctttcttcgtttcctagcacttctgaagggtcattccagcttaagaactccctgaacggtcagctgaggcccttactaagactgcgtcagagctcaacttctccctctgcccctacacgttgaccccaagaacactcctaaatagacatactgcatgctcacctcaatctcagggtatgcttcccagtcacccaaactatgatattatctttaagtaagtaaaccctaggcatttgggactgatttctagaatgctcttaatctaaaactctccaaagtgtaggtcaaaacttttccataatagtgtgcatattttctccccattgctcctttatcaagtacttgggaattaaggtaaagaatatttggaagaattaaagtggggtagacttcctgcatatctctcaggggtcaaacacacctgtttgtggccactgactttcgcaaaaccatctcatctttggccttgggcacactctgtcgtctgaacacctctcaacagaaggtgccctcctcactacactccaagacttccctttcaatccaactgaaaaatttgaatctattaagaaaatacgcttttttggaagctcttagaaaacaattacagtgaaacatgtttctctctctctctctctttttaaatttgtaccatcaattggaaaggggctttgagacactatactaccattgcccttttgattccctctcaaatttgaaagctttatttatgatgcaaaaatagccatcatgattaattggttttttcaagtgtctatcatttttcaccaaggataactgctatgattagcaagaagaacctccatacaaatctatttaatcatctaaaattcatatttgttttaaggatgactgttattttgactgataacgtaaaatactactatgatttcagcgcaaagttaaagtgtgaagaaaagtaatacagaggttggcataaccatcaaagggaatttcttaaagaatatagaacaaattcaactacagagtagagatttattatttactaagatcttaaaacatgctttttaaattctgataacgaaaatatgacatagagtttgctatcctagttttacagttgaacaaactgtaatagaatagatcctaaaatttgtgcaggttgtcaataacatacagggcaaggttttagatgcctgactttaaacaaagctcatgctatttctacaaatacaagaaaaccagaaaaaaatattcacatagtcttaaagcttctctatatttcaggagggggtgaagtaactgaattatattaacagtgttctttaccatgatacccaattcttgtcatgaataaaaggtgatgttcagagatgtcatcaaataattgacaaaaaaaaaaaaaaggataagaaaaaaggaatgaaataaggtagtgaccaaaccttccctttttatcagtgatcaaaatccttgcttttacatatttataaaatccattctatttctctggatgtgtaatgaaagaaaatgaatatgtatgttcatttctaatccatttgaaataacaaaagagatggcattctgagtccacattctctttccagattttaagttttataattacttacgtaacactatcaacgaataggacaatagaatacaaacaaaaagtgaatcctttttagaagacagtttgagtacaaactgctatatattatgtactactctttaaagctctcatgcagattttaataattaatcaatattctaaatataaattactatatgtaaagcagtaatctatttttataaataaaatgatttcgtagaatgctgtgttaaattctttccctcagacagttgctctagagaaggaatggctgcttggaccctggtaggtacatcatggtgagaggcacaaatgttatcctggtaacaacttcacaaattatagacatagtgcgaagagaaaagatttctaaaagattaatttggtaaaagcatatgtagagaaatcaagtgactcagagggacatacacatccaactaagataatgttctctcagctgtgctcctcaagatgctctacacaaatggtttccatggagaaatcactgagaaatactgagctaacaatactaacattcctaaaagacttttcagtgaccttactatggagatgtacatcatagattgctaggataggcaacgtctatgcatgtttttcagcttatttgaccttttcatgaggatcatgtatgaacacctgatgaacctggttttctgtaggacaattttggaaatgttgagatcttttatcaactagaaatgatagtatatttcctagtcaaaatattttttaaccactttattgatttcttaaccactttattgacataaaaagctatacacatttaatgaacacagcttgatgagtttcgagataattacagttatgtgctgcataaggacattttgatcaatggaccactatcatgtgcacagtctgtatacatgtaggacagtggtcctataagattataatatttttctgtaacttttctatgtttagatgtgattagatacacaaatacttgccatcgtgttccaattgcctgaagtattcagtacagtcacatgctgtactggtttatagcctaggagcaataggctataccatacaacctagatgtatagtaggatgtaccatctaggtttgtgtaagtacactgtatgatgtttgcacaacaagatcaatcagctaaccatgcatttctccgaatgtatatctgttgttgagcaatgcatgactgtatacccctgtgaaatcatgtccagaatctatgccataaacctatgcatcacctccaaaatttttctcttaccttccttatttactattatttttgcatgtacgataataacaggtaaaaaaagatttactctcttagcaaagttttaaatataaaacattgttaactacaagccctaggctgtacagatttgtaggacttattcatctcatatgactgaaacctagttagtattttttttttttttttttttgagatggagtcttgctctgtcgcccaggctggagtgcagtagcctcccgagtagctgggaccacaggcacccaccaccacgcctggctaattttttgtatttttagtagagacgtggtttcaccgtgttagccaggatggtctcaatcttctgacctcgtgatccgcccgcctcatcctcccaaagtgctgggattacaggcgtgagccaccgcgcctggcccctagttagtatcttaatactcattattttccattttaacggcacaaaacagctgagattatgagagacaagagtggttattcttattagaacaaccatagaaggagggcaatatctacaagtttgggccatggggtggtgctgctatgaatagactacgaatggccatgtaaatattggggtttgtgacaaaagataggaaagcctatctcaagaaggaaaaaaaagtgttacaagaaaggcaacattggtaaggaagaaaaacttgatctttaaaacatgttattctaaacagactatattacttgttttcttgtttgattatcattgctagaactggtaatgtttttattgctcagtgtatactttctcttgaactcagtgggtttatttgggtcttaataattcagaatataaaaactgatgacctaataccacgtatattgatgctaacggacatgtttagaatttgtcagactatgtaagctattatgaaagttactgctttctctttctccaacataaaaatattcagaggcagaaagatagacatgaataatagagttttttctccattttatttccttgatttctgaaacaaatttaaacagaactaagaagacaggaaaacaatcacatcatatttagctaagttaaaactgcttatgtccaaagaagaaaaatgtgcattattaagagtatcttggctagcatagccagctgcctatccgataccctttctttccttcttagctaaaaaaatccaaattctgttcagactagcaaggttttataactaagttaccaattttcacattttgaattatgaagaaagaaacacacctattcagttaaaacactcaatcctcccaagatccttagaagttaggaatggtcacgtgacacatttctggttaatgcactgttcaagtagaaactcttctgtgtggggctgccagaaaagcactggttttccttacaaacaggagctgacacagctggaatatgcttttactttccccattttcccttcttccattttaaagtacagacatagtgcctggaggcagagtagccatgttgagaccacaggaaaaaaagtcttgctgggcacggtggctcacgcctgtaatcccaccactttgggaggctgaggcaggcagatcatgaggtcaggagatcgagaccatcctggccaacatggtgaaaccccgtctctactaaaaatacaaaaattagctgggcgtggtggtgcgttcccgtaatcccagctactcaggaggctgaggcaggagaatcccttgaaccagggagtcagaggttgcagtgagtcgagatcgcgccactgcactccagcctggcgacagagactccatctcaaaacaaaaacaaaaacaaaaacaacaaaacaaaacaaaaagaaagtctcatgttggagatgactggggttggaggaaaaagttgggacatacggttttggaggtgctgcactgaccctggaacacataattctggaagtcttgctctatgagaaaaagaaactatctggataagccactgtagtgagaatgctgtcacgcatagctaaacacaatcttaacagagtaaactggaaaaaaaaaatcctttaatttctaaaattcttagagtgtctaaaattatgattgtttttgcatcgatgcagtaaatttaattctcaggagactttcattcatcattgaccaaaacaagacatgaatcatattgcatttaacagttaagataaacatatatatgaatatagctctataaaatgttgtcatattccaaatactaagtaaaactagtaatctgtgaagataaagtaaatcaacaatatttataaagcacctagtacatctttagcggctatgtcaaatagaatattacaccttcctttacaggaaatttaaatttatttcgaggaccagaaaataacaatctaaaaagtcaaatgacaacatacatttgaaaagaaaagttcaagacaacagaagcagctttacaagaaaatatatagttaaaggacaaaatgattttggactgaatcattgatgaaaaagaccaatacatattggcagccgggcacggtggctcacgcctgtaatccccgcactttgggaggccaaggcaggtggatcatgaggtcaggtatttgagaccagcctggccaccatagtgaaaccccatctctactaaaaataaaaaaaattagccgggtgtggtggtgagtgcctgtaatcccagctactcaggaggctgaagcaggagaatcgcttgaacctaggtggcggaggttgcagtgagccgagatcgtgccactgcactccagcccgggcaacagtgcgagactccatctcaaaaaaacaaaacaaaaacaaaaacaaaacaaaacaaaaacgaccagtacatactggaattaacaaaacaacctttacagaaaaggcaggaataaatctcaaaggcttcaagctgtgacataccagtcaactatataatcattatattaatcaactttaaggagtgtgaagaaaccttaagtcattggtatggttaataattggatttggtcagaactcacaccttgaatgtttgcatggtcctcacctacaaagtttccaaatgttaaaataaaatatatcctcatttttatttatttattattttagttttatattttattcttttttagaaatggagttttgttccattgcccaggttggaatccagtggcgctatcatagctcactgcagcctcgaactcctgggcccaagagatcatgtcacctcagcctcctgagtagctaaggctacaagcccacaccatcacagccagctaactttttatttcatttttttgtagagatgaagtctcactctgttgcccaggttgctcttgaacttctggcctcaagggatcctccatcctggcactgatattacaagtgtgagccattgtgtctggacccgtcctcattttcatttagaaaacaattgtactgtaaaatctcattatatatagcttcttgcctgcttgcattctttccaactactgatctttgcccccagtaaatgtcctcttctagtgcctaacatctattacataacttaaaaaaatcaaacttgagtaagtgtggtaaagtggcaggctaatttttatgtagaatttctcagaggggacttctgattctatctgtggaagcatttcattactttcgtataatataacatgacagaaagcttagcctcaatgaagttgctacaggttattttccctctcactacaatctacttctttcacatttagggaaaaaatatgggattaagagtaaattactctctccaaattactctctcctctccactttcttaagtatagaatcaactcaatttatctatatgcttttggcaaaaatcgtcttcatggatttaattttttttaatttctagtttgagtgttcaaaaataattctggagttgaacatagattaacttgatatgggggaggggttacattggtcattacagtttattttgcttccataattgaagagagaagatgacagttaaatcaaagcatttctgttcttgaaataaataatacagtatatattcttttcttgaataaatcataggagatatataattcttaaatattatgtcacttgtttacacagaatataaaatataaaggtaagggaactgaaagcatttgtgaattactaaaattgtattcaaagttatttttataaatcgaataagaaattgactcaaatcattttagaaaccgtggcattatttttaatgaattctttaaaaatcataaaagcacaatcaaatcctgttgctttttttttttcaaaaacaatgcagccattactaccttggaaattactgatcaattcatttatgaaatttaaaaacattaaaacatatgcaaaaatcaactttcactcccaagttattgaataaaaatcaacaagatccctggaaagataaacatagcttaattttcatctatatgaaaaaggcaggcacatatttagaataagaaatcacaattgatcagttgatttattcattctaatacatatatgattgaaaccaccataacacttttttcttttgtggccatgactgccctatcttttatgtttttcttatagaggatacactctaaaattagggcctatccctttttaatttttgttccctaagagcagataacactgatgcctttcaccagcaagtgttcaataaataacagatgaatgtaaactcagtattgtatcaaaagctcttaaaagacagtcaatatatttctaaagaatctttatgacactgtaactcgaggtatcaaaagtaagcacttgaaggaggaaagaaaatactagtagtatttaattacagactattaaaatatctacttaatgtatacgttaattttatataatatgtatcactttaacataagtaaccatatacataaaagtgtggatacaggtacagaaacacttttactaatagtgatgtgtgatcactgcctcatcttattcacacttattcactatcatacacaaggaaatcaaatttaaatccaaattattactctagtgtctctttctattctcctttcttaatagtcttcaacctgactctagagtgctttgtaacatgggtttcaaagacaatttgttgaacgaaggaatgaaaaaaacaaccatatacctaacattaacattagttaacattaccctaacattaaaggtaataataagaaaaatttacatcataacacactgtaacttcaattacagactttaaggaccaaaagttatggtgaaatggaaagcctaaaaggcaggtcctaaactttagggaacaataacattatataactttcagaaaattaaaaaaaaaccttattacattgctttcctgtaagaaagttagagaagacccagattctacgtatttctatgaaaacaataaaaatcactccatataaaggagccctaactagatccaagaaaggaaatttgtaaatagaattctctaattatttatttatttgagacggagtttcgctcttgttgcccaggctggagtgcaatggtgtgatctcggctcactgcaacatctgcctcccgggttcaagcgattctcctgcctcagcctcaggagtagctggggctacaggcatgcgccaccacgcccggctaattttgtatttttagtagagacggggtttctccatgttggtcaggctggtctcaaactcctgacctcaggtgatacacccgcctcagcctcccaaagtgctgggattacaggcgtgagctaccatgcccggcccagaattctctatttaaacacaatggcaaacataaacttccttatcagaatcccactggtattttatggaaaacacagtacagtgacttccatcagaattcatgtaaatatcctggatcagttttgcttgataagattttgacagaaaagtttacagtgaattgaattaaaatataataagatacacatttccattcatagactttgaaatgtgtagtttagtatagtttataagtttatgtagtttctttaagaaaaaagcatatggtatcattttccataaaaaggtaattaggagacttagaaaatatgattttgtgtgtgtgtgtgtgtgtgtgtgtgtgtttgcaactctatgacctttttatttaaggggcggtttatttttgttatgaccagagaatataaaataagtcacattactgacactgacatatctttacatccttcgttgaagataatagtggatttggtctcattaggtaaagaaagaaaattatataaatatggatcagtcatccagatggtcgcaagctgtctaccagagacatgtacatttgttggaagataattaaagcacaaaatttgtaaatatcttcagccaaacagattacaacattaatttcttaattaatttcttaattggtatttcttaaacaagtttgtgcagaaatgaaatgatgagatgagaagggctggattgttgatcgatgaaagagaaaaacagaataatcaatctcctcaccctaagatgactgtcacccaacctcgtgaaatccatttgatgcccatggaaataaaccatgtttgctttgttttgttataatttggatggagaaatgagatgtgtaagaagttgaggggggtggctgaggaaatagaaaagaagtaagaaacattatctattcccaagaggtctgggggtctgggtttatgttaggacaattacatttactaagtgactttagatcaattaactaaattgtctataacttctctcatttgttgaataagggaaactattgtaatagccactttctgctgggtttgtgacaacagaataaaaccaagaaacattctgttttgtattgcttttagtttaaatagccaatgccactttacccacacattgtcccatcaattcttccagggctatactacacaagttgtttagtaatcagattttgactgaatctattcaccaaaagttataatcagaattattctgtagctaattcaaatgctttttgtgtatagacagagttttaaaaaatcataatttttaagtactttgaccttaacaacaacaacaaaaattaaactcattcaagtaattatgtcccatttaaatatacactatacccactaaaactgctcattcaatttttagataatgaaatctcccaggtaacagtgcaatgtgtggttaaaaattaatcttgaacaatgctattatcatcttgtccagattggccaatttgtctcaaccccaatctggaaaggtcttactggaggataaaatgcctttgccaactcaattctttattcaatacaagtgcagtggttgagattttgtggtgaattatcctgaacacctggccaaacggaattgaaaaaaaagactacaattaactcagcacaggcaatcagacaccagtattatgaaaaataatatcatatggccatctaaattctatttgttgatagcaacactagtctccactgctgggaacctctcttcatatttccccctccacctttctccctcctgtctcccaccatccctcttccatttcctcctttcctcactcctcttttgtcctctttaatattcctttcttgtctttttttctttccttgctacctttcttttgtcttttctctctccttcccctttttcctgctttccttcctctcttccttctttttttccctttcctcctccttccttccctttctttcctcccttctttgttctctccttcctttccttaagggtcagatttagtaatcactctcaaagcaaaacccaggacatatttttcccttcatttgatagattatgtcaaaaaagaaaactgctaattcttgtcaaatattgttgtttcagagcaattttacttatgtttatgtgatgaaacagaaaaagcattttttaatcagatttctccgacactaagctataaagtacaaatcatccactgctattgattcacaattctagaaattaaactttgaacttcatgtgtgctttacttctaaaggcttaatttgcatatttcacatctctattcttctaaaagataatggtatattttctactgtctaaaatgaagcagatttgcttaatttttttaaatggctgtattcttaaaacttaaaaaaattaaagttgtaattgtagcttccatttttttcactgaatataattcacttagtaaaaattatttttatttcaaaatggaagcagctcaccattttctaaaataatactttaatcaagcaatacatactaaaggggaccataagcttttcaccaaatatgttttctgagttcaaagtctaaagctagtgaaaggttagcttacttgaatgtcatgtccttataccccttctgtggcaaatatttcaattactgcacgtctaaggtttggtctgaatctcataactaactttgccttgagtcataaaatgtctcattgcattatcttatctatcttctggtgctttggaattataatcctcacattccagtctttgttgaatatgaagtttccttatcacattgcattcacattatccatcaagctatccacatttattgagaaccaattactgtacgtgtcatggtcaaacaaatttatatttcaggtattggtatatgaatggtctttatttcaggtctacacgttgtgaagttgagtagatgaacctgttgctttagatcagctgtatccaatcttttggcttccctgggccacactggaagaagaattgtcctgggccacacataaaatacactaacactaatgatagctgatgagcaaaaaaaagtcacaaaaagtatctcatgttttaagaaagtttacaaatttgtgttgggccacattcaaagccatcctgggacgcatgtggctcacaggccatgagttgaacaagcttgctttagatcataataattacctcctacaaatctcctttatttgctctatcctccaacttattctacatgttcttgactgagttcagtggacaattattgtttagtggttggtcagaatcatttccttcttctattgtcaatagaacccagtttctattcaggagaattgcctttccctaattttgagactttgggaggagagggatttaaatcaaagttttctgctcccttctagctcatgtattaacatgtgacccaaacaaggtgaactggactctcttttaagactttaaaatttgaacagagttacacacaggatggagaaaagagagtatcacaaacagactggaatacttcttgctagccacatgcccagaaaggcatgctcagattctttttccttttgtaagttttgttccaatgcctttgtgctaattacagcacatttactttctgcctgatttaatcagagaatgatttctgttgcttgcatccagagagctctaattgataggcaactaaactatatgtgatgattttattttcctgtttacaatcctttcagagttgccactgcctgtaggccatcatcaaaattcctcagtctggcaacaaaggattcccattatttagccccagtcctctctattcaacctcatcaatttcttcctcatcatatacccttaacttcagccatatggaatcacaattcctctgatatactctgttttttttccacctcagtgaaaagcacagtctgttccctctgcctggattgcccttctcgttttatctagctaggtaattccaactcattctttaatgcctggcttaagtttttccttcttcaggaatatctcactagcatccattctctctcctggcttagttttccctgaagaaagccccaacagcatcacccacacaatatcagagaagttgaaaactatgaggtttaagggagaggactctggaaccaaactgcctgagttcacatctcatcattgtctttcttcctcgatctcaggcaggttattatccttactgtgcctctctatctacctcacagtaatgttgtaagcattaaagaattcacgtgaagtacttagatcaatgactggcatatcatatgtgttagctattatcctaaaatttatctctatcatagtgttattattttcttccttcaacctcttttacctgcacattctatgttgtacaactttatgtttcccaggtacttagtggcagctcaatagaagttggttaaaataataaaaatggataggtgttagtaaagtttttttcagtttataaagcccttttggaattttgcctaatttttcacacatcaaacattaaagttgggattgctttatttaaaactttacataaaattgatattgatttcctgaaattataacaaaatcctccccatacttacttatccttcttatttcccctctcacacacatttgtttaatgattatttagggccattttaccgacaatttggtgattgaggctataaaagccaagaactgacaatgtctttaagaattattttttaatataagaggaagaggcaggcaaagcatccccctattcagcaagcaagagaagggagattagatttttttataaatatgtaatatatgaacattacatatcattatatataatatgctatatatactattttaaaaatatttttatatataccatatataatttataaatcctgtatttttgtgtctcagaaatggcttttgatttttccccctaaatttttttttttctgagatggagtctcactctgtcactcagtctggagtgcaatggtgtgatctcagctcaatggaacctctggtccaggattcaagtgattctcctgcctcagcctccctagtagctgggattataggcatgggccaccacaccagctaatttttttattttcagtagagatggggtttggccatgttgaccaggctggtctcaaactcctgacctcaagtgatccacctgcctcagcctcccaaagcgctgggagtgcaggcgtgaaacattgcacctggccctctacattagtttttgacctatatttaaagacgatctctgtgagggggcatcaaatcagtagtcctttctgaaaaggacacatttatttagagaactctggagactactgagcacatcaatggcttccctaaatgctggactcacaaacccgtcacaaggaagtgtggactttctctcccaatctattatctggtaacttctgcaggaagctatgtcaatggtagactaggctacagaagcggaaacaagctctcatttccatataatattatgatgtgatatacagtttgcataatacaaatgccatcattggttagatttctagagttcgtggtggaaccaaatataattactaacatttgttcaatactagcagtaagcagtaagcaaggcaaagtgggaagcatttttcatgtaccaaccaacttaatcctgatgacaaactgcaaggcagatagtacaactatccccattttatagctagataaacttgggctcaggtaggcagaataacttactcaaggtcacacagcttgggagccaagctttgaacccagacaatgtaacttcaaaacctgggctttaaacattataaaatattgtttcctttggtaaataaaagtcctgggagtattatataactcaatatggtattgtaaaagaacgtacctcttgtttctgtatgtatcagtacatagcaaccataaaatgctcagcatagtgtctgacatagactacatctacatctacatacaaatcactaaatagtaactgcagttacagttattaccgcagcaatagtatgtattgcttgcagtacatatattacttgctacgtatactctctgcagtagcaagtaataacacaagcttaggaatcaaatggacttggatttgaatccttgttctgctacttactgggaatttgacatctatgagcctcagttactttttctgaaaaatgtggctataattactttttttaaagcagaagtaaaacaaattttaggtacatatatgtagtatttacatatatttatatacatccatatccataactatattgtgaatgtgaatgtgtactctgtatgctctgtactcagaataggaaacgaagatccagagatggcttgaccacaatcatcatttgcaaatggcactgaattcaggtcttctgtattcaagctcaaggcctttaaatgcaggttgtttactatcaaattacttttattcctatggaattggtgaagtttattttacaaagaaattccccttactctgtctgcctcacttcttgttttttcaaaaggtagtactttaatacctaaataccttcagcacaactttgtatttctttagaaaggcttgaaagctgttacaagtgaaaaaactttaatgtataacaattccaacattatttttcttaatcattcacaaatataaaagatatatagtatatttgatctagctaggtaaaccatatttacatcaatgtattctaatgtttctagttgatgtcataattttaccaaatggattacactgaggctgaaaaatgcactatttgtattaaaaacatgttcatttgaacatggcattgcataaatgccaactttaagatctagggtaattttaaatatcttatgttttgttacttttctctttttaagttatagctctctttcaattatccttatcattggagaaggcaaattggcacagacaacttagaagagtggataataatcaattcccagactattatatttgattctgcaatatgttgggctgcgtagtgccaaaacaaacagtttaaatgtaaatagctcagttgagtgacttatttggtataaaatagatttttaaaataccaggttgtttagtaaatttaactgagacaactattcttgtaaggtttctgcttttttttttttttttttttgtatatttcctttttaatgtatggctacttttgttatttgcattaatttatatccttgattatacttaggctgaatagtgagagtaatgtgtttgctgagagagaaacagttgcctaagaactggtgggaaatggtctaggagagtaaagtgattggtggaaaatcttcattttaaagaaaaacttctgccaacttttatcattttttctcataccttctgcttgatgatcatctcgttgatatcctcaaggtcacccaccatcaccctctgtgattttataacttgatcaagcagagaaagccagtcggtaagttctgtccaagcccggttgaaatctgccagagcaggtacctccaacatcaaggaagatggcatttctagtttggagatggcagtttccttagtaaccacaggttgtgtcaccagagtaacagtctgagtaggagctaaaatattttgggtttttgcaaaaaggaaaaaagaagaaaaagaaaaattagaaacacaagctaaagagccaatttcaataacaataagtcaaatttaattgaagagtaacaatttgagccaaactcttattcatgacattatatatctttttctaacaatgtggatactttgtttagcaatacatggtagaaaatgaaaagattcaaccttttcattaatatacatttaacaattttttaaaaaacgattttgctcattctcatgcctggacaagtaacttaagttaaataagccttctcagtaacaatcatatacattgtggaagtggtaaagaaaacaaaagttttcagaccttgccagggaaataaattttacttattttttttttattcaagaaaaaacaaaggcaaaacaagatgggataagatcttctttctgatttaaaattcccttgaataggaagtaaattaatttgaagctggaccctagggaaatcaaagccaatgaaacgttcttgtcttagctctgtattttatactgggagcagtttatcatatttttttctttttatttcagattgttagtaaactggccagcagtgaagaaaaaccaagatacaatattttcttaaaaatgcgagttagtagtttttctatttagacatgaaatactgtttcaaagtcattaaataaatcttaatatgaatagtgttggacactgtagagtaagtcagcctatggtaatggttaagatgcatagtactagaattaaaatgtctggtagacaatcctgttctctgccctaggaactctgggaccttggtaaagccacataacctctctaagtttcagttctaacatttgttcagtactagcaataagcagtaagcaaggcaaagtgggaagcatttttcatgtatttaccttaaaagaggaataataacagggtaaatgtcataagggcagttgtgtagattcagtgagtagtacaagcaatacacgtatgacaatgccagaaagagcagcataatcatcatcatcacaataatattattacagcgcctgacactatagtaggtgatcaatagtgttaggtattactgtttttataaacgcctggctagtaagaaacacagtgatgaacaactgtggtgagaaactggagataaggccccaaaatgtgaaatacttggggagtagtcagtcaaaagtccgtgtgtggccctatattgattgaagagggctgaacttgctggtgtgaattgatactaaataccaacacacagctgggttatcagaggtgagtggtgaggggaaggaatgcctaatcaagtttatagacaacagactcaagagcataatataaccagaagattggtggcaaaattattggactatgtagtttggaatgaaaggtttcaaggaaagctgcaaaagacatctcaacaggagactcacactggacaaccagtgaacgattctaagaatattaaaaaaaaatgagacattgaattttcattctgaggtagccaatcattaatttttatggctatgtaactgtgcttttaaggttgtctcctcattagagaagaagatgagtagaatggaagaatgtttcttgtctctcaagcttctcagggacaccaagagttttctatgaatgaaggaactaattttgatcaatgcagacagaaaaaaatagtgttttaattgtcagagagaataaaaaaatttgtgtcacgaaacaatgattgaaaggcagtaacagtgaggcaataaagaaaaagttttgtttctcaaagctatctgactactctgaggctctttctagaaagaattaaatgtaatgtaaagaagaaatagcattttgtgtcacagtccaggagaagaaatcatggaagcaaaaagatctagaaatcttaaaagggattccaggaaaggagctaaatatccagagaggatgcatgtgtgaggatgaaaagagagctaaattaaaatatcactgtaggaactaactgcagaacaccaggctgactggcaaatgtggatggagtgttcctaaaatagatacacaaggtatactgaggcaatatacagcaatttaggaggatttcaagcttatgggaagtgtcagaaaatgcttttttaaaaagtgacttattgaaaatttgaccctcaaataagagcagagacaagagattttttttttttctccagacttacttctgaccatgaaagaagtacctaatgaggtggaaatgatcatgtcacactaaatttcaataaagtgaaggatgaggaactagagaattatcagacttcaacaagcagaccactgtttcctgaaaagcacgtttggaaaaagacagaaaggaagaaggaaagaagaaagtcagggagggagggagggaggaaggagggagggagggagggagggaatctattgaaaagcaaggcaagacaaggcaggaaggcaggaaggaaggaagtcaggaagccaggcagtaagggaaggaaggaggaaggaatctattggaagtctattgaaaagcaaggccagggcctgagactcaaaaagagagaatggttcatgatgactaaatatgccattgggatgataaattagctgaagcatattcagaggatgatggagaggtctagcaatgcggccatccctgcgccagtcatgggcagataatctcatctatagacccgtcaggccagtatttctggtcttctcttctccagcatgcaccacctgaagaacatctatctgtacactgctgggaaagggaggggaaaccttatcagactttctcactgctctatctcttgcatcttgcacatgtcctggagtataggaggtgctcaattgattccctttgaatctaaagaaaagtcaatgtgcagtaagctctttagtgaacttagaggtcttctacatacaatgagtactaaaatttaacagccacccattagaatggaagaatggaggctagaacacaaaacatgcctaggtttttactagttaggtgattttagctattttcacgagaagataatggaggaagacccactgcttggagcagacaatgaaagatcaaatattaaagagagaaaatacagccagtcaatttatttgcccccaaccccacacacatacattttttttcctatcgaagggagaaaagcaggaaatagctctgaatcagaaagcagggtgtagaatatttaggctttctaggaccagattgttgtatttgaatccttgctctataattttttttttttttagctgtgtaactatagtcagatgacttaacctctctgaatctccatttactcctctgtaaagtggcgattataatagtacttccttcatagacaactggccttactttttcctaaatagacaatcttggaaaagtaatgttcactgacattggaggcatcttgaggtaaggaattatactatgcctgctacaatgaacatcttgaccctcaaaagttttcacctgtgtaactatgaaaacagtaccaatctaatggaattgtgttacggattttatgacatcatacatgtaagtcacctcctaggattgttctgactgtaagtacactatgtggatttttttcttcctctttttcctgcatttctcacacaatggttattggctcctcatgttctacattcgtatgggattttatgctctgtactctgaaccagatttgaccctccagacttacctctctccattctttccaggctcctccacacccatgtctattgtgcattctctcatgagcacaggccatttcaaacctgtgtcctttcatacgctttctatacttcttgaaaactttttctctcctgtttccagacaaaaatctcattttctctttaaatgtcaactctagatttctgtgttttggggaggaccagaataagaagtgtgtaactaaaatatctccatgaggaacagaattacacctttcttgtgggtcctaaacactttttagtctttaacgttttcttacttaaatctagttatcactaggaaggacaaaatcttgcaccactattaggttttggaggattttgaaagtgtctagaggatagctgatagtagttgagagttggattctaaagtcagaaactttgggtctcaaggaatatactttaaaacataaagaagcaagaggctaatcttcatcgacctctcacattagagccatttctgttcagaaaaacattacttaaaatattttatgttttctaaaaagacttgcctctggattcaggcatgtatatatttttttcattttttaatcaaagtgtttcaaaggacagaagttttgaagtcctgaaattttttttttttttttttttttttgagacagagtgttgctctgttgccaggctggagtgcagtggcgtgatctcagctcactgcaatctctgcctcgcgggttcaagcgattcccctgcctcagcctcctgagtatctgggactacaggcatttgccaccatgcccaactaattttttgtactttagtggagacggggtttcaccatgttggccaggatggtctcgatctcctgacctcgtgatctgcctgcctcggcctcccaaagtgctgggattacaggcatgagccaccatgcccggcctatttatcttattttattgtatatatcacattgattcttactgcactttcagatgcgtttacctttatctaacacatatgcggttctttcttttccaccatgtcatagtactagaaatatatgcaaatcacctttttcagtgaagtgtaggctggtcagatttgttagtggttttgtacagtctgagcaacctgttcacagttctaagggtcaggcagggtcgtattgttgtgccaaggatatttcctgttaagtcaatattttaaaagactgaaagaggatttgttttgctaagagtgcctgaatccataatctagaacgaacgggtaaagagttaggatatataaattattacatagaattttcaatgatgttctgggctgggtctcctgttgtcatccctaaggagcatgggaaatggcttcccctccagctggcggaaatcctttcccgtgtaccctatttaatcttaaccccaagtctgttcatgcctgggcattcaccccgtttcttatgcccctatcttgggttacaagaagctggctctggtattagctggttcagatctcagcctctctaaccacctcagagactaagggtattcttctcaagtccattggaggaattgtcttttcctgcctagggtccttactgaaaatagtctttctgatgttatgctattaaaggttcctccagtaacagatttgggtgggttttgtttgtttgttttttgctcaatcaccttatgccagaaccagatgtattacaatgtacaaaattaaactgtatatctaggtagacagatagatacacacattgtgtgtgtgtgtgtgtgtgtgtgtgtgtgtgtaaagagagacagacagagacagagcaagagagagagagggcatctgaatagtctgaggacatactatgtagcataatacctttctcatgcattcattagaaaattaaaatgactctactaaaattgtggttttccctccatagttaagcagacagaaaatcaagctcaaaatagttgaaatgaattgagtttggcacaccagaatggtagcatgaataacagtaggtgtaatatactattgcaaaccacagctttgctctgagtattttgttaattaaaaggtgttggctttaggaaggaactcttatttttttcaagtgtttgaagaacacttctctagtctgaaaatttaattggtttcaggggtacatgattagtcagactaacagctttacttagagctttaaaggagctactaaatcttttaaaacacacacacaatgtgtttggcatatttcctttgaagtattcacacatggttttcctgtaattcacaggtctcctttggttgataagaaagcaagaagcacatactctatttctagctttgttgaatgaatgtgggtaactttttttgtttgcttcacttttatatttgaaaaatcactcaacttacaaaataagttattgggctcacattaacaattctatgagagaatatctaaaaagtgctgttagatattcccttcctccttatcattccatgtcaacaggagagcaatgttatatgtgatcaaattgcattactatttaatactatggggtataagaaagattgttagcgacttccatctcactagtagataaaataactctcctccatgtaagcaacattggagaatattttctttttgaatatttgaaaggatggcatttggattaatgaattccgtaagaattcaagagaacttctgaagaaaatttgaaatcatgtctagattctaagaaagacaatctattgtgtaggtaaggaagaatttcatgtcttccctctaaatatttacagtctgcacatacaagttggaaaattagaaacaaacactatgaacacataaacacttatttttgtctgctttcttttctgtcactctaaagagtaaataaaatatatgacacacctaacatcaataattctcattttagaaaaataaatgcttgtactctacataggcaaggccggagtactggaactcaaggattcatgataaccatttgtatttctggatttaagaaaaaaaaatgttaagtttgggagctatggatttttaaagcttaatggtgctatttgcttacattttaatagattctttcttgctattaaaaatataatccaaataaatatttgctactacttacaagtaagataattgccaccaacactgccatcacccccatcatttactcagtgattcttatgtgctaggcaaggttcttcataaaccctcttttatttcacctttaccaaaccatcttcagggtagatgttatcatcccccttttaccaaggtaacgaaacttgttcaggatctcacattaacaagtgatgtttccaagacaatgtgcttaaccactgcacatatttctaagaatcataggacatcaggtatctttcttacatgtctcattcaatatgcaagaattattaatcactcaaatacttctaagagctatagcttataatatatggtatccatgaaatatatctaatatccattttaatttgggagagaagatcatttgatatagctataaaaatatggattgtaacaatcaagcgcatctggcatccactcacaacttaaatattacccttgagaaatatctccaacctgactttaaacatatccttccttcactaacttgaatagagaaataatcattgccttttcctgttttagttggcatcatctaagtgcccttctataactaacattatatgaattcatctacatgcgctcagtgaaaagcagggtttctcaatctcagcactattgacatttttgtcccagataattttttgtcgtgagtggctgtcctgtgcattgtaggatcagaattgcttgtcagtatctctggccagagctccctcctagatgtacaaccaaaaatgtctcctgacattaccaaatgtctcctgaggaaagaaaaattgcttatggttgagcatgtctcaattaaaaggattttccatctctccctacccacccacctctcaaatagctgcttagaatttgtgctggaaatcatttatgcctatccaattttttttttctcattcctcagaagtagaaattaagagaaattgttaagggcttctctttccaacatgatattgggcaggcactgaagtatccataagtaaaccacaaacttatggctgccaaggaataataaataatattacacaggaactgtcttagtgacaaaaatgacaacatctctgctggagagtaaatgtccacagattctcctcttgcatctacacttttgtcaagagatattccagattctcccattaagagccatagtctgtttctccactccttgaatatggattggtcaagtcacttgtttcggctaatgaggtatcagcaaacatgacataagcagaggcttaacaatgcttgggtgttgggctatgcttggaactcttccaccgctatggaactatgctagcctgatgaataattacaggcaagtgatcctgtcacccacaccgtctcaacttataaccaaaaagttataccagacatatgaatgccacatgtggtcatcaactaccagctgaccacgagtgcatgaatgagcacagctgagtctagcaaaagaatcgcctcgatgaaccaagccccaagcagaatcaagaatcatgagctaaaaaaaaaaaatgattcttattttaagtctctacatttggggtagcttgttacacagcaatagatagctgacacagcatccatttttacctgttaaacacttgtacgcaaaacaggatttaaaattcccttcccattaccacagaaattaaaagaaaaatgcttatccagcagagagaacacagctggaaaagacggagtctttaagttaaaatgtggaatggaattccacagagaatggaagattcacatagtcactctatgaggtcaataaatcaggcagccagcatttgacaggatatttgaagaaagtaacacttttagcagaaactcactattaatgcactaagacctttgtatatgaaaaaagtagagtatgtaataataagagccaagaagtaggcagcccagtgcagaagacaagggaagaaaaagccagatgaaaccataataaagaccacgctattgatgaagggtggtcatcaattgcaaaactgatatcagaataaaatccatataaccatttgagtataaccagctagagaacattgtgtagttcttattacagaaaatacactgctattctaccaaaattctgagcaccttaaaaaactcctgaattaaataatttattctgatttgggtttgtttattcaattttttaaaatagagttcctcctacctgaatgttagagacaagactctgcagtgaaaactaagcaaaatgaggtaagcagtgttttctacagaattcagtctaaatctcttatttgtttgggagagctacgttttcaccttaagcagaaaaataattagtgatgtgttttgaaagttgttatataatgaataagatcctctaccatgtgtcaggccctcacaagcctcatccaccagaggagatgataagctatttgagataagtatcagaatcatcttttccttcctcacaagaccaaaggtctgaaaaataacagggtctcaatcaaaatttgttgttgttttcacaattagaatgaggtgcaagttgcaatgtactaagcagagtccttaagtgtaatctcgttctctctctaaatatatatatgcatatgtatatatagtctaaatatatatatttagagagagacagagaagttatataaattaatataacagagttatgtaactgtgatttacagtttcctcagagtttcaatctagaacttcatcagtgagaaaaaagaggaaccattagtgcaatgtaaatgcgacaatattaaatagtcttaaaatgtagattcttttggttcaaatcaattataatatatttgcacaagatctggacagcataaaaatgcctttttagtcattttctgcattggttcctcatcataccactctggtgtggatagggaaaacatgattactatcaatttatagaacgggaaactaaattcagataaattaaaatacttcttcaagatcaacatttagtaaattagatgaaaggttctgagaaatctgtattttaagaagaaaggctctgaggtgagtaattaataaggaattcaccaaaaacaattaacctgattttaaaatgggcaaggatttaaatagacatttctccaaagaaaatatatacacagccaacaagcatctgaaaacatactcaacatcgtcaatcatcggggaaatgcaaatgaagaacgaaaaccacaatgagatattacctcacaaccatgaggatgaccacgatcataaacagaaaataacatgtgctggcaaggatgtggagaaactgaaacacttctgcattgttggtgggaatgtgaaaaggtgtagccactatggaaaaccgtatggaagttcctcaaaacataaaaatagaattatcatataatccagtcctcaaaaaataaaaatagaattatcatataatccagcaatcccatttctgggtgtacggttagtccccaacttactaaggtctaacttgtaatttttggactttacaatggtgtgaaagcgatatgcattcattaagaaaccatacttcaaattttgaattttgatcttttctagggctagtaaatatgcagtatgatactctcttctgacatattgggttgcagcatgatatttatcatgaggataaataattgatactctactatgtactgtgttgcaagatgattttgcccagatgtactgtaatctacatgttctgataacatttaaagtatgctagactaagcaatgatgtttggtagcttaggcatattaaattaatttttgacatgatattttcaacttatgatgggctgattgggatgtaatcccagtgtaaatcaatgagcatctgtatatccaaaagaattaaaaacaggatcttaaagagatatttgcacactcatattaactgcggcataattcacaatagccaaaaattgaagtaactaaaatgtccattgattgataaacggattaaaaaatgtggtataggacacaacggaatattattactcggccacaaaaaaagaaggaaatcctttcctatgctacaacatgggtgtaccttgaagacattatgctaagtgaaataagccagtcataaaatgacaaatactgcatgcttccttttatatgatgtatctaaagtagttaaactctttagagacagaaagtagagtggtcatattgccagtgctggggtacagggagcaatgggagctcttcagtgggtttggagtttcggatttgagagatgaaaacattctagagatctgttgaataacaatgtatgtatagttaacactactggtttgtacacataaaacagttaagctggcaaagtttgtattatgtgggttttgtttttcaaccacattttttaaattatactttaagttctgggatacatgtgcagaatgtacaggtttgctacgtaggtatacacgtgccatggtggtttgctgtacccatcaacccttcatctacattaggtatttctcctaacgttatccctccctctgccccccaatcccccaactggtgtgtgatgttcccctcccccatctccatgtgttctcatcgttcaactcccacttatgagtgagaacatgcggtgtttggttttctgttcctgtgttagtttgctgagaatgatggtttccagcttcatccatgtccttacaaaggacacgaacgcatccttttttatggctgcatagtattctatggtgtatatgtgccacattttctgtatccagtctattattgatggacatttgggttggttccaagtctttgctattgtaaacagtgctgcaacaaacgtacgtgtgcatgtgtctttacagtagaatgatttataatcctttgggtatatacccagtaatgggatggctgagttaaatggtatttctggttgtagatccttgaggaatcgccacacggtcttccacaatggttgaagtaattcacactcccaccaacagtgtaaaagcgttcctatttctccacatcctctccagcatctgttgtttcctgactttttaatgatcgcctttctaactgatgtgagatggtatctcattgcggttttgatttgcatttctctaatgaccagtgatgatgagctttttttcatgtgtcttttggccacataaatgtcttcttttgagaagagtctgtttatatccttcccccactttttgatggggttgtttgtttttttcttgtaaatttgattaaaccacattttattttaaaagggaattcatagaccaggtgaattgtggactttttaaaattcccttctgagttaaggagatttaaaagagatttttttgagtactataataaatatcatcctgtaaattccaatggttctgatatattaaggcccagtggaaaataatcgatttattttatgtcctcactactcctacttgcatcctcattgcaatatttgtggggtaagcagaatatgccagtgcctctctgtagtggatactgtaatgcttcatcaagatcctcttctggagtcgatgcacccacactaccaatattattcctagtatttgtggtgtggttgcattgactccagaataataatatctacaaaaggatcacagctgcatttctccctggtgcctgctcttggctagtgcaaagatacaaaagtctcgcccatttgcctcaatttggtagaactctgaaagaccatcccagctccagtgtccctgtcacatgggctgaagcctcagtagcaactgcagtgtggatgagcttttctctctgcccaatactgcctccttcacttccttataaatagcaacaatacttctcaaaatactttctgtgtgcaactttttgtctcagagactgttgccaaggaatctcatctctgacaccgtatctctggtctatttacgtaatagtttgtttttaatacatagaagtaatatgattttttcaggcattcgatagtagaatattttttaaagttaattataagccaggcgctgtggctcatgcctgtaataccagcactttgggaggctgaggtggtagaacacctgaggtccggagttcaaggccagcctgatcattatggtgaaaccctgtctctactaaaagtacaaaattagccaggcgtggtggtgcatggctgtaatcccagctacttgggaggctgaggcaggagaatcacttgaaactaagaggtggaggttgcagtgagctgagatcatgccattgcactccagcctgggagacaaagcaagaatcattctctaaataaataaataaaaagttaattatttattggtatcacatgttatataattcaattgaatgctctaaaaaatgacaaaaagtatgcagaggattgttggcatatttattgtttaagggcttataaagtagttttacactccttgggtatatttgagtttcaatgtatcatcagagttgctgtttcttatgtgaaatatgcacacttcctgtaactaaaagacccatgagcttgacaaattcaactgctgaagtcttgaactccgtcttcataatgaccttggaaatgtaactgctatcttaagttggtttgaagtgactgtattgaactaaacttgagttttaacgttctgggtcagtaaacatgttatgaattgcaggtatggaaaacacactaactgaaatagtggaactagctacatcaaaatcaatttatgtttttatttaacttgtagaaaaccatactatgcccagaagtgcgacaactaccaaccatacaaaagagatcaaaatcaaggggagaaaacaggtaacacttacgtaggaaaaattgcttgttagaagcacaacaaataaaaatttggtgtttgtttctttaagacatccctgccaaaccatctcaaattctttttgaacgtatgaaaggtaatcataaataaaacatggtttcagtggttttaaattatgctattgaaataacaatgttcctcagagcattagcatgacagttttgatgcacatacttcctattgtcttggacttgaatctcattgtcttaatccttttgatgaatgggtttaaaattaagagtgtaaagagtgtatggaaaagctgtgagcccacagtaaatggtttctgaagtagaaacatatccaactctgtttattcagaaagatctgtgaagctgtattattacagttgcttcattatgaacttatttttgctgcttacaaaggggaaatcccatcagatcagggctaagataattcctttttaaacaatcagtaaatcatatttaaaccttgtttacactagtactttttccatgatggcgttgttttacataaaatacatgctttcaatcttgttaaatttgttaggactcattttgtggcctaacatatgatctaccctgaagaattgtttcttgtgcacttgataagaatgtatattctcctgctgttagatgagatgtactgtatatgtctgctaggtctatttgatctaaagcataaagtccaatgcattcttattgattttttaatgtggattttctgtctattgttgaatttggggtagaagtcccctactattattgtactgtagtttgtctctttctttttatcactttatatttgctttatatatttaggtactccaatgttgggtgcatatatatttacaattgttataccttcttgatgaattgatccttttatcattatttaatgaccttctttgtgtctttttagtttttgatttttaaagcctattttgtctaatagaagtatggctatccccattctcttttggtttccatttgcatggaaaccaaaatatctttttctatctcttctatttcagtcaacatgtgtcctaaaagatgacgtgagtctcttatgggcagcatgtagttgagtcttgttgttttaatccatttggccactctatctttagactggtgaatttaatccatttacattcaaagtaaatattgataggtaggaatttactactgccatttaaaaagttgttttctaattgttttgtagatcctttgttctatatgcctttttttgttgtcttcttttatggtttgactgttttgctcagtagtatactttgattccttactttttaccttttgtatatctactataggtttttgcttttgctactataggtttttgcttttctttacatcttacgtaagggttttttaagctggtaataacttaactttgattgcatacaaaactctacacgcttacttccctaatccacattttgtaatttcaatgtcacaacctatatcttctttataatttgtctcttttaaccaattattgtagctataagcacattgggatgtgagagttctttttagtagagatcacacaaattttgcattttaaaatgttacttgaaaataaaattttcaatgaagttatatttaagattcaattattccaaggtaaagttaattacaaagtccagaatggaaaatcatgctatttttttcattagtagaaaaataataatccttaaaaatgatgtttcttttttcctaagatatctagataagaactaaaagtaaaatgtatttcctctactgtaaaattacaatctatattaatccattattttaaaacaaaaagatacgaagggagaaaatttttatcaagttatgttacaaaatctctagcttattgcatgaaattaaaccacataaaagaaataataaacctaactgaaacaacattaactcctatctagggtttatcaaactacagaaaacagaaaggaaaggaattatacatcttgagaaacataactactaaatactggtggaaactatacatgtgcatagttttgaattggtaaaattcttcatttttgccctgtaaatggtggaaagaatgaaaaaagtcactaaagctctgtttcctacttttgtactaattcaaaggcatgattatgctatacttaataactatttctacttaaaaattgttaatcattgtgattttaacacctaatgtatatattttctgtggaatacaagaacgtgaacagaggcaaagagctaggtagaaagaccaatttccaaagagaaagtagggttagtttactactgggggcctcacattcccattcaatctgacgtaaaagtggaattgaagggcatatgggctgaagttatcagagactgtattgctaaaatggataatcttcccctattgacaatgggggcctgtggctaccaaaattaggtgacttgaacagataaaaccataacaagttcggatcctttcatgcatctattttcaaaaatgatattttggtgattagtgaatcagatttattattatgataaaaatgagtaagtaaattatttataaaaacgtaagctatcaaaaacttagttttcagtgccatgaaaatataggttatagtaacttgtgaagatcttcaggaaggttaatttatactgtacattctaaaccatagatgctacatctggtaatattaagttgggaagggatttatctgggaaaacaccatcatttatcaattaaaccaaggcagaaaaggttgaatagtttgcccaaaacccccaaaccatagccaacaagagatcaaatgaggactagatcccaggtttattaattcccaatccagtgatcttttaacagtgcctggtttacaatatcatgagcatgcttctgaaatattaaaaatgttacgtctctatataataactttatatctagcatgcgtagattgagaaaaatagtgacaaaatcaacttattctgaattcagtaatattgtaatataattttgcatttattaattgcagtagcatctacatcacttaaaaaatgtctactacatgtttgtgggtaatgcatcactcctttgattcacagacaacacttgaggtggttgtggatttgagaatttctttcaatggtcctgggaaattttagctatatccagcacacaggttgagaacttctataatgttggtctctgccttgcaacattactcttaaccaaatatctttaaaagtcgtactctttactcttagagttgatttcagtttcattgttgccaaacaatgatatctcaatcatttgacaatgggttgtggcatagatataaaatatccaaattgtctaaatatttttatatttttttataaattagaaccaactaaaggttgtcaatataagagtactctcgcattccaaagtgcttttctgagtgagagagggtgcacagtcagaactagtgtgcttgaattttgctatttaacttcattcacctttacatatctgtagcccctgacatgaatatctatcttcaggcaagtgagtgaatattgccaacatctgtgatgatactggtaggatagggatgggggcaaaacaaaggttgaaaaatcctatatgaccatatccaatacctgaattctcttccactttacttacagaaagtgatttcccactgcttaccccaaaagtacacattgtgtcaaactagccagtctctttatgtaatacccaatatgctttcactctttacaaaataaatttatccttgttgtttcttagacttttttttgcacccattttattccttactaatgtctacgatcacaatcttctgtgaagtctttgttgacaactctagttaacccatacagtcttctttccaaactcctatgttgatttcagtcttacatatttatttatattattatttgctatctcaattgtaaaattctacaattggaaggaaattatggaaattccaatgctgaactttaaaatctttctcctttgagcattgtaaatcttagactgaaatgctttacatataatttagtagatgtttaatattctcaagaggtatgcctaagagtctttgcaaatcaaaaagcagatttatatgatctgatagtcttacttaggagttaagggattcatccctgcccagtagtttcccagtacatgaaattagtactggaggccttccttacatgttagaaccacccaattacccaataggatcaatgctattaaacacattagaaatcactacatatcatggacctttagaaagcaatattttatcacttcatatgagttatttagcttaggacaatgttttgccatttcttatttagattatgagaaatgtcacatctcattttaaaaattatttcttagtatatcacatcattctgattatctgcactaaagcaaaatcttccaaacataaaggagttttcaaaatatgttctaccattagaaattagcatgacggctgtattttcatttaacatattttacaaaaggaaataataggttcatgaatgagaaagctgttttctgtcgtgtctttgataatctgaatttagtctaacagaatagctttcatttaagtattattactgaataattactaacttagtaaagggtttatacctacttagtaacgaagcaggatatttccctgacccctttgtggaactcgcaacaggggtgccttatttacttagcccactgctctcaactcctcactggagggagtgtgcaagcaaacgaggtgggaactggagtgcatgagcactggagcagcatctaggtggaggcgtctgcgacccctgaagccccagagggtgtgttacagtgctctgttagctctgccatccacggacagcttaggcgttaacagctcagtgggccatttgtcttttcacaggaggcagctgccctccaccagcaagggcaaagggccttttgtattcacacttgtggctcctgagctcttgtccagcatctagggaaaatgaggtcacatgaacaaattgaaggattgtaaatgtgagggattgtactgccgatgaaagtggctctcagtgggaaggggagctgaaaaggggatgggggtggcaagtaatcttcccctgaagtccagccggattcttctctaaagttatgccatcaagttgtccctctgaagtcaagctgcttctctctgatgtccagctgtagtcctgtctaccagctgagtctggggtttttataggcacaggatggggtggggtggggccatgggtggtttagaaaaaggcaacattcgagcaggaaaactgggatataagttcccactttgagctgcggtttcaggctttttggcttgagggtggggttttcgctggggaccatcccttttctgcctagagcttctctgcctcctgccgctatcagtacgagagttgtgtaaatgcctatattgatacaggtgctcctcaacgtacaatgggattatttcctgataaacccatcatacgttgaaaacatcataaattgaaaaacccatcataagttgaaaacatcataaattgaaaaatgcatttaataaacctaacctactgaacatcattgcttagcctagcctaccttcaacatggtcagaacacttacattagcctacagttgggcaaaatcatctaacacaaagcctattttattaaaggtgttgaacatctcatgtaatttattgaatactgtattgaacatgaaaagcagaacagttgtatgagtacttgaagtatgatttctactgagtgcatattactttcacaccattgtaaaataaaaatatcctaagccgaaccattgtaaatcaaaacatttttagattgggaccctctgtatatttctttatttctcaggcccttgacaaaaggagataattgaagcattcttatttttattaaacagtgaacatatgtgctaacaaaggaaaattatattcagagaaatcagcacttgcccttgtattacacaggaagtgctaaaagctttactctttagagttaaatgctaagaaatttagattggtataggttacatacaagttttcccgacaattctatatcttgaaaaaaaaaatctaacattgtattatctgagactacagcacagttggactggtttagactaaaactagggtaagggaagtggtgttaaaattgattgaagattatagtatacgtctaaaatcttgggcatcattaataaagcccactctacttggacttattgctctattcatatcctttctgaaagataaactacctcaaaattcaggacccaatagtaatatactattattgcggagatgccatgaaacattcctggggctgtgatcgggatgattgagaggagcgctaaatgctgaaaagtggatgtgaccagggaatggcttagctgtttgccagtgtaaaaaataacttgatatcaacattaagcagcagctgaagaatcttttaatagtttaggcactttttctaaatccttcagttatgcttcaccgattaaattattaagaacctctgatctagctatttcatattttagatgtgagtgaagatgttttgaaatcattttcattgttcatggtttcttgttttttaaaattaaacctagaggacgctgagataatctctttttattaggtctgcagaaaccaagaatacaccaaatgctgaatagctgcatggaagtatcacttgccttgacaatattgtattatgataagctagttcctcttttttttttttttaagttgagctatatagattccaattaatgttgttaaaccaattgtttaaaaaatggccagaggcttctactggcttttagatggaggccaagatatgattgcgtcaaagatcaagataaggatcagaaacgaaatttaggaagagcctcccaatgtgaatgactaaattgtatatgattaacttttctaaaaatacttctcgttgtcatttagtttataaatagcttgcagataatattgtcttcctataggttcgttgaacaaatattaactgggtacctttgggcccagtgtcaccccaatggagtgaatattgttggtggcttaaacaacttccattcaaagatatccctacacccactctgaaattctgctttctaggagaattccaattgtcttcaagtttctacggaatccatcctcagttctggagatggatttagattcacctaaatcttcgattctaagccagtcaagataatctcatcctcttggttcaggaagaaaagtttaaatcaaccagcttatgaaaccattctgaatcatctttagtacaatagtagatatatatgaatacctaatacatatactaatgatacagtagatacacaattaaaattttgattgttcttatctgagggtgaaatctctgaatctgtgaggtaagtgtttatgtctctcactgtaacaagaaattatgttacccatttgttgctggcagtcatcttggaacctggagggcaactagtgaggaggtcaaagctgacgcagagaaaaaaatcaggacaaagaaagtcatagagaaagagtgacagagctctgcttgtacttcatctggagccagctttaacctctgaacttccagttatgtgagttgaattattcttatttttgaagccactttgaaagtgcattctctttcttgcagcccaaagcatcttaactattaaatatgtcaccagggtaacataaatatgccaacaattaatctcagtaaaatattatgatacttgctgaaataggagtaaattttaaaatgataatatggagagagaagcacatgcattcccctggaggactaagtaggaaaaaaggtacttacacaaataatattataaactgagaatgtaatggtaagtttaccaaagagcctattatgacaaatgtatttctagcaaaaggaagaatatatgttaaagtataaaggcagcaattggtgattagggagttacaaatagtttagtattacttgatttttcaagagagaggagggaagatgtaggaaataccctagatagactagtaggtaccaaatccatgaacggccttgtgtaccaagctgaaaaatttagcttttatcctagaagagaaagagaactattatacaacctttactaatacattatgattggcatgttaaaaagtgtagttttaatggatttgcagtgtacaagatgagctgagagacagaaaaactagtgaagaggttttgtagaagatgctatctgaatgaatgagaaaacaaaattgcagtgctaaataagagataagaaatttcaagcttatttgtcttaacaagatcgaaaggattggtaatttatcgtggggcttaatattaaggaataaagaaagtgccagaaaaacttcctgatttttaacatggccagtccattagattgtgtcattcacaaaaatagggaatatagtaagaggaatagattttcagaaaataatgataacatcaattttacatatcctgagttagaaatacctgtggaacatctacgtggtagcttgtcagcaggtgaaaatatgagtttggaattgaagagagaagcctgaactagagataatcattggcatagtttcagtagtcttaatcttagattctctaataaatggaattggtagtaaaattatttgaattaagataatgctatagttcagatgttgtcccctccaaatctcatgttgaaatttgatcctcaatattggaggtggggcttaacgggaagtgtggggtcatgggggtggatccttcttgaatggcttaatgcccttcctgggggcaggttgagtgactgctcattctgttaggttctgcaagagctagttgccaaataacagcctggcacttcccctctctctcttgtttatgctctctaaccatgtgatctctacacaccagctcccctttgcccttcaccatgaatggaagaagcctgaggccctcatgagaagttggtagtggtgccatgcttttttgtacagcctgcagaaccatgagccaaataaaccttccattctttataaattgcccagtctctggcattcctttatagcaacatacatgaacaaagacagatggtaaattttccgttatgtgctgtttgccacaataaaaaatttaaaaaaattgacaataagtacaggataggtgatggccaatcagccaagatgctggccatagagcaatgcagactaggaatgggttaacttccaggtgatattaacactgaagagggctaacagggaaaaaagtaaactaagtagaaatggttggaagtgaccacagagatcactgaaaaaccaaaccaaaccagagaatgtgcaatctcagaaactaacacaatagagaatttaaattgaagagggataggtgatccttgggtaagactatttaaaggcactgagggtgagattacagaaccctagcaaagggcaaaacagttaataaataaaatcttgtccagtagattaatactaattacgtcttaaattaatactcaccatgtgatgcaatttaaaaaacaattatatttaccaagaatgttaggtaaaatgtgcataaaaatagaattacttgacctaatatattaataatttgaactcaagaagcaaactatagtaagaaagacagagtagaaagttttcaagtcaatggattactgaagagtacatgtgacaggcaaataaacactggtagataaatatattaaggaatttggagtggcagattctttctgacatataggatgacaaagaatgtaaaaaatgaaagactggaacaaaaatcagaggagataagggacatataaagtgaaatataaagaaccaggaagatttataggtggtaagaattggaagtgaccaactggtttcaagaaaacaaagaatcttcagtgagaggagctgaagacaggcgtgatgtggcaacctccaaaaaaagacttaaagtgaatttttccgctactgcaatatttttttgttctcaaacaatatttttgcttttcttttataggtggaaatagtgaggatgatagtacactgaaaagacatttcatggttctgacattcaaattgtaaaatatatcgggttgaatgacaaaattacttcatcccccttttaaaatttctatggtacttttgagtctcaaaatcaagggaaaactaatacttttgaagctcatacagtttttgttctagaagttttgtcttttttgtgagcataaatttacccagtgggttcaggaagaagatgagtatttttttttttcaaagcaaacaacgagacagcaggaggttgaaagttctccacatggagttgtcactcaagcactgacatcaaaatcaatgaaaagtggctccagtcttgtgctaagtataatttgtagcagagaggaagttggaggcaaagtgtgaggagaagagagctgagaaaaatagatagtcagatattcagcaaacacaggggaaataaagaggaataaaccctaaagttggcaaaatgatccaaattccaaatggaatgaagtaaaaaaaaaaaaaaaagtggcagcaccatgtagtgcaaacatcactggactgagaatcatttgacaacagacactctgggagtctacttgatctgggcaccattctaggcactgggagtacagtggtaaatgtggcacaggcaatggcctcatggaatttatattgtgatatagaaaagagacaggaaatatacatttaacatcattttagattatatgaaaggcagtaaagcaaaacagagccaggaaaaaagtaagagagtgagagggttgcaagttgggctagggtctatgaaaaactagcccttagctcattatgaaggtttggatgagactttttatccctctaaatttccttagctcccctagctagctttgtctctggaacaagatgacagtttatttcatctttatttccatttctttacatacttcctcttttactgctactactcattctccacttctctttttcactcccctttggtactccttgtttccagaagactctgatccccagctcaagggttccttctctgtactgagtcttgctcgtaattatcttgtgtaacttcaggatttctatattgaacaatacgctgatttctatttctgccttcctcattcattcccaggtaatggggattcaatgaaaatcgacaagaggggatgttggttgtattagtctgttctcatgctgctatgaagaaatacccgagactgggtaatttatgaagaaaacagttttaattgattcaccattctgcatggctggggaggcctcaggaaacttacaatcatggcagaaggcacctcttcacagggtggcaggagggagaatgagtgccagcaggggaaacgccagacacttataaaaccatcagatctcatgtgaaatcacccactatcatgagaatagcatgggggaaactgcctccatgattcaattacctctcactgggtccctcccatgacacctggggattttggagattacaattcaaggtgagatttgggtggggacacagccaaaacatatcattctgctcctggcccctcccaaatctcatgtcatcacatttcaaaacacaataatgccttcccaacagtcacccaaagtcttaactcattccaacattaacccaaaagtccaagtccaaagtttcatctaaggcaaagcaagtcccatccgcctatgagcctgaaaatccaaaacaagttagttacttccaggatacaatggggggtacaggcattgggtaaatacacctgttccgaatgggagaaattggccaaaataaaggggttacaggccacatgcaagtcttaaatccaatagggcagtcattacactttgaactgcccaaatgatctcctttgactacatgtctcacatccaggtcatgctgatgcaagaggtgggctcccatggccttgggcagctctgcccttgtggctttgcagggtacagccccctcccagctgctatcatggctagcactgagtatctgcagcttttctagatgcatggttcaaactatcagcatttctgactattctggggtttggatgatggtggtcctcttctcacagctccactaggcagtgccccagtggggactctgtgtggagctccgaccccacattttccttctgcactgtcccagcagagaggttttccatgagggccctgcccctgcagcaaacttctgcctggacacctaggcttttccatacatcctctgaattctaggcagaggttgcaaacctcaattcttgacttctgtccaaccccaggcccaacaccacatgtaagccactaaggcctgcaccctctgaagcaacagcctgagctgtactttggcttctttgagccacagctggtatgcagggcacgaagtcctgagactccacaaagcagcacggccctgtgcctggcccgtgaaaccatgttttccttttaggcctctgggcttgtgatgggaggggctgccattaagacctctgacatgccctggagacatcttccccattgtcttggcgcttaacatttggctcctttacttaagcaaagttctgcagccagcttgtatttctcagaaaatgggtttttcttttctatcacattgttaggctgcagattttccaaactttgatgctctgcttccctttaaaacaaagttccaatttcagatcatctctctcaagttcaaatttccacagatctctaggccaggggaaaatgctgccagtctctttgctaaagcttagcaacagtgtcctttgctccagttcccaagaagttcctaatctccatctgagaccacctcagcctggacttcatcgtccacatcaccatcggcattttggtcaaaaccattcaacaagtctctaggaagtttcaaattttcccacattttcctgtcatcttctagccctccaaactgttccaacctgtgcctcttacccagttccaagtcacttccacattttcaggtatatttacagcaataccccactctctgcagtaccaatttactgtattagtccgttctcatgctgctatgaagaaatacccaagaccgggtaatttataaagaaaagaggtttaatagactcacagttccgcatggcttcagaggcctccggaaacttacaatcatggaggaaggcaccttttcacagggtgataggagagagaatgagtgccagcaagggaaatgccagatgcttataaaaccatcagatctcatgagaactcattcactatcacgacaacagcatggggggaaacaaacccatgattcaattacttccccctgggtccctcccacaacacatgggaattacagggattacaattcaaggtgagatttgggtggggacacagccaaaccatatcattggtcaaagggcacaaactttcagttataagatgtctggggatctaatgtacattatggttactatagttaataatactttactgtttacttgaaatttgctacaagactggatcttaagtgtcctcatcccccccccccaacacacacacaatagtaactatttcttgtgctagatgtattaattaatttgattgtggtaatcatctcacaatatagtcatataaaatcatcatgttgtataccttgaatacatacagtttttatttctcaattatacttcaataaagctaggtaaggaggaggcagagtatgtcctcaagaagctcacaattgagtagggggaacaacatgaattcaaattgtcccacaaataaatataagatttggtgtgtgctctggaagaggagtataaatagtgccatttacactaacctagtttgggaggtaaggagcgtctttcctgagtataacatttgagctgagacctgaaaagtgagtaggtatgaggtcaaaaattcaaaaggatagtgtctcaatcagagagaccaatatgtgcaatggctttaaaaaacagaaaataagcactttcataagcaaaacaaaactaggagggaggtcaatgtggagataagagagtaagtagttcacagtatctggtataaggatgatgaaatggaaagggtcacactatacaagatcctgtgggatatcatttctttttttgaaatttttattttgagataaatggtaaggtactggagcattttaaacagagttctgtctgtcatcaaatttatattttgaattttcacacagctaagatgcataggagagaagaaatgaatgaggagagattaggtttggatgacagtattatttaacccaataacctgcatagtgttacaagtgaaaggtgggactattagtcactctgaggcaatgacataaagcatgttttctctaggcaaatcaagactatgatcatcctaatataagactactgtaacagtccaggaaagagatgatgagattgtacaggggtatgcaggataaatctaaaaatgaaagctgaaccaagaaatatttaggagcaaaaaaatcaactgaacttagtggtggatgtccagcaggggtgaggtgggaaggttttaagaatgacccccaagattttgttactggatagctaagtggtgctacaaaacctgaagaaaggaatatatcaggggaaggtcatgcatttcatagcagtaaaagatcatgagattatttttgagacatctaagtggaactgttgagtaggcagttaaatatgcagtatggaatacagaggaacttttttcatgccttaaagtcttctcctctttcagttccatttttcttattgttgtctttgggtcccctgaaaacagggcctggatgaggacttgggtacagatagctcatttggaagctgatccctaggaagcaagaatgaaaaaccaaaagagtgagacagagggggaggaaatgccaatcaaatgtattatcatcaaggtaatgcttatggaccatggggactgtattttgacagaacttttgtatgttcctgagaatcacagagaattccccttgcccccggaaggaatagtggttaaaaatatatccatgggctcccatctccattggttgaaggttgctcactcactaaaacttcaagggtgagaaagctcacaaaatctgtgggctcctgggatgtcagagaagtcccttagatagaaagtagaaaaatgggagccattcccttgacatgggatgctgtcagctaaaggcaagtctgaactcacacagggctgtccactgcagctgcaactgcagtgcaggaaaatggcgtgtgactccaggcaccaggggaatctgttacaattgtgatgataatcttttggaagcttttattttcttttacagtgaaatctgtcttatctatagatgattacatagaacgtacacataaagtgtgaagaataattataaagcaacactttatgtaaatacaaccccaatcaagaaatagaatactgctaataccttgaccccacccttgtgttccccacagcacaatcgcctccatctccctggaagtaaccattctcctgaatttttctccttttcttttctttccctccctccctccctccctccctcccttccttcctttctttgtcttcctctctctctttctctgtttctctctctctctctctctctctctttctttttattttttgagacggagtttcactcttgttgcccaggctggagcgcaatggcacaatcttggctcaccgcaacctccacctcctgggttcaagcgattctcctgcctcagcctcccgagtagctgggattacaggcatgcgccaccatgcctggctgattttgtatttttagtagagacacggtttctccatgttggtcaggctggtctcaaactcccgacctcaggtgatccacccacctcggccccccaaagtgttgggattacaggcgtgagccaccgtgcctggcctctccttttactttttacctgctgccttctccagcctagatgtttaggtgttcttaccctcgagacttcagctttgttttatcataacgctggttaactctggcatccatatttttagcctaaacttctctcctgactcatatgctcagttacctcagtggccttgcaaaactagatgtctaaaattgaactcacagttcccctgaaccctaaaatactccatagtttagtaatttctaccacggtctactcggtttatcaagccaaatgcctgggtgttctattcgcgttctctgtatctctccattttatgtccaatcagttaccagggcctgttgtttccacgtgccaagtatcacttgaatctgtctactttgtctccattccctttattacttctttagtttaggtcattattatctatcacctgaaccactggaatagcctccaaagttgctcttatccaatcagttacctattcttcagccagagtaatccctctaaaacccaaatatgctcatgtcactagtctctctacaatgcttcagtggctttcaattacccttcaaataaaatgtgtttgatttctctaacatgtcttaaaatgcagtttgcgaacatgcatgcatttccagcatcatctggaatgtcctccctgacacatcgctcctcacccattcccaaccccaactcagtgcttcagccatactgatatttttaaaacgtgctaggctccattttgcctccaactgttacttgtttctcttgcctggaacactctcccctacttgtttgcctaggtacacctacttatccttcaagtctcatcttcaaatttccttttttttttttttttccagaatttttcctctgacatcgctctgttgcaatactccagactgggtgaggtgattcttcctgattcttccctagtattctacatcctagtatttgtcacgtacagttatttagttttcttactttctaggagtctaggaatcacgcttatcttgatccatattgtatccctagaatctaacacacaggagggcacacagtaatccttaataaattatttgtcagattagtatattgataaattaaggatacaaatgagtaacctacagttaaagaaggaactgcaccagttaagtcaaatagtgtactggaaaatggcttcttatccccctgatggtgacatctcctgctgcctgtaactatataatttaactcttcctaactaattcattatttaaatgatagtcagttgaagtggcattatcatagctcttttctgctaatctatgacgctgctttgggagaccattctacctttgtacaagtatgccatttcaagtttcaaagaaagctgagatgtggtgtataacattttaatctcgagaactatgagcagtaattagatttcccataatatcgaaattattacttctacttaggtatatttaagggtacttcaatatctaaatatatgggacttatagtcatgagaatttagaaaatctaagacctagttatcccctttctttgtattttttgatgctgagataggaaaacgttatccaaagtgagaacaaatgttttaggctcgagtccttttatataactactactcatcattttttcaaatgatagtggaacactcttaagagttgtaccaggtatttcacatctctttattctttccatgagtggctttataaatgtccattctatgctaagtaagtggtattctttgttctgagtaagcattaataacactgctgatgataagaaatattttttcccctggaggaagccttaagaagattagggaaacacattaaacaatctatattccctttattagctacaaggaatctattgactagtatttatctaaaacaggggtcagtgaactacggcttgtgggccaaatccaaccaactgcctgttcttgcaaacacacttttattggaacacagccacacttatgcatttacaaactgcctatggctgctttgcacctcattagcagagttgagtaacttcaacaaagatcttctggcttgtaaaacccaaaatatttactatctggctttttacagaaaaaattggcaaaacttcgaccaaaaccttcttgaagtgacttacattactaacctatacctcccgctgaaacagtaaattatataaaccaataattgactttataaatatggattttttatttgcctcaaatcgtgtcttccaagattcaaatggcatcccctaattgcaatgtattatgatttggtgaataaattcttgttctcactactgtagttagaagaaaaatggactaggaatacgaagagaaaagattctgtcctgattctcctcttattcagtttcctcaactgcgggaatttataatcttcattcttaagggaaattttagataatatatacatgtaaacaattttattattttttgatcagatggatttcaatattttgttttcttcactctagggttcactaactacagtcataacttgtttcagttgatattcatgtgacagtctgatcaaatgtatcatttgttcagttattctgctacctccaatttattccttgagtgtgcatcccttggtatggcttattgctgacctcattatttctgcccacgcaggtctatccactcattcatctcaatccacttgcatccatggccttgctcacactgggttttactataatgcttcagatttatccagatgagaaaaataaattccagccaagaagcatgcttaagtgggacactggctagaggaaaggtcaacaatatccattatgataagtggtaacacctctgttaactccctttttattttacagaaattttattatcatctagtccagtgacttttagtatttttaaagcatacaacccttttttcaagtgagctcctaagaagaaatccggtatgtgaagcctaaaaagggcgagagcaacagactggttgaaattgcagatgggaggcaaagggaagtatgaacatatgttggaggaaactctacccttttgacggccgaaggggacgctttccagaagaggtgatgaactctatgtttctggtttgtgtgattgattgaagttccagcccatattcatttctacgatttcatgctgtaggcaattgggtccacttattcaccacagccaccgaacaaagaaaacactagaaaatactttcagagaatcaggtctgaacacaaaaaagaattttccaagggagtcgtggtgcccttaagattaaatgaagtgctgtttaaacatatttatttaattgattttgacttgcagcagggtgctggactatggtaccctatagattttccagatctactttttgtaattctgctgctgtactggctttttgaccttgaattgacagttacagatgtgggagaataaataaagctaagtagtaacactgtgggagaatcaagcctatcatcttaatgtctttttctctcctgattgccttctattctagaggagccaaaaaaagaaaagaaaagaaaagaaaagaacgtatatatttcttcatattgaaaccacttccgtaactctgaggttatagtattaagcttcaaaggtactactacttaaggcccaattccacccacggagatttaataaaagatttagatgtcatgcaaaacggaaaagaaaggggaagagagagtattgttgtttaatttcatttggaaaatatgtacaaaagcatgcacaatatggtagaattggtcctagagtatatggagtcttcattcatagactgcatgaccaagattcagtatgtttaacataaaggtaaaagacaggcatgaactttataaagactcaggttcaaggccatgctgtgcccacttagtagctgggtgtttttggataaccattctctctaggctttcatttcctctcatggtgaaaaataataataatgtagtacctatttcataaggctgctgtaagattaaacagaaaaatgcacaaagaatacttggcaaaatgcctggtacagagcaaggcattaatgcgtgttagccctaagataaatattaggtatgttcgggtcaatgcaaaagctagggggaataatcgaaatgaaagcaggtattatttttgaaaatggctatgataggcctatatattactggaatagaaccaaactgtgagaccttagagaccctccaggagagttaaacatgaagtgacaatgttgttttgcctgatttacatcagacttatgttgttaaagcaccccttttttcaatatgaagcatttattcacccagataatggatacaaatccatgcattcaaatgttccttggagtcagagatcaagatggaaatccccagaatcatagagatttgcgtctgtaaactggcttattatattcacattcaaagaggttggaaggggcagtgtcagctttttaactagaatcttttcattacttctccctgttggggttgcaacacatgctgtgagtgacctccagagattcctcaagctgtatgcaggcagcaaattgaatctgaaagctttattagacaagtttttcttgtctttcagctggtgggagtggatgtcagttgtattggaaaaaataaaacttcttgtgaaactgggtcctgaccttgaaaaaaaagctcaaatcgaagtgtacaattcaatcctgagttatgtgcttatttgttaaacagtgtgcaggttcaaaggaaaagggcatattttaccttaaagaaataagaatcaacaataaaaataataggagttctgttttgatcatgctgaacttagtaagcaaaagtgcctatcaccaaatcacatagttatgaaaagtatgctaataatcgaagaaacaattcccattcacttcagtatgacaagaaaactattataatccataatgaacattatagaacatttatttatattgtgtattcatacatttctttgagaataaagaagagtcctgggaaaatgaagggacattggagattggctagtttgttttatttcaatattgtctctcatatatacatataaaatctcttatatatatatgagtttatatataaatatatatgagtttatatataaatatatatgagtttatatatatatgagtttatatataaatatatatgagtttatatatatagtttcctatataaaaactatatagagatatagctatctgtatatataaccatatatagtgacatgtaatatatatataaactatatacagttatatgtctatatagctatatatatatagtgatgtaatttagttcctggtttttaatattggagaacaattatgagtttttttgaaggtgtgataattattccagaagtaggaattgaaagtagtataattttgactttttttttcctattgtaggtttatattgcaatttaagtgggtactggtatagttagtgctgctagcaattttacctaaatattaggatacctagattgtttgtctaatgaactcagcatgggctggcaagcactttggaaataagagtaaaacatattttcataaaaatactgaagatgagagaaggaataaaccttatgaattttaagaggaaggtagcatgtaaagcagaggttctcaaatttgatttcaagacacagtcaagaatgagggtttaaggagataggggttatatctggcctggaagatttgcatcaatgccatagaatatccctctttgatcagcactgtaatcttaaaaaaatagggcttactactgagattgtgaagatatatatatatatctgtcagctgtgtctcagcagggaacaaagttgagatatataagaatgctgaagagcactgaaattaaactcaggagatgtggggttgggtccagattctgccactaaacagctggtcaagcacgcgatcatttaatcttcttggtattattattattacatgggaaggttgatgtatttgatctatctgtaaaatatatgttcacttgaccaaaaaatattagtgcaatacctaccatatgctagtcattgaattaaagctagacacacctggtatttggcatgtaaacgtaggaaaagggtatatatagactttatgatgtgacagagtcatgggaagaccagtaattatggaacagcatccaattctgaagcccacaacagaaaaatagtatggaaaacacttggaagggtaggaggagggccacagagacgttaaaaatttgagaaacagctgttttgttgccagaccatggggactcatctgatttaagatagaaaagaaaagtgggaaggagattaaataacagacctcaaagaatgaacactgtcgaaatgtacagtaagcataaatgtatttttcctattcgaataaaaataatttagacagtaactggaacttaggttaggtagttgaaaaactgtcaagtatagcagattggtagaactccatctgctcttcactttttaagaagagagttggcagttacgcttctaagattgcttctaatagaatgagagcctttcctgagatagtggaaaagaaagaatgactgttcaaatacttttcagaccacaatcttaaaatcgacaattgaagtacaaaactgctacaatttcctttcgaaatcttgtttctctctgaaggtaaagttatattcaattttaaaactattcagtgaagttttaggaaatattaggaatacatgttgaagccttccattttgagcggtagggtacttactctcataaatatgcctaaatagttctggtttcttggtcagagtatgacagtcaagattatggtatactctgtagtgatttcaagcaaaagtcctttcttgaagagtgttaaatagcataagaaggttaaagtaagtttactgtaattaacattttatttctgttaaaatgcaggacataggtaatcaaaaaatctctaatcatcagaattgatgttagccttctctttttcctagaaatgatgaactagagtttctcttccttcatcagttcagaccccaaagcacaaccctaactggaaatggtaaccatgcaataaaactaccaaaaggttaagagagggagaagaaagggaacttcatcacaaaatggataattaacatctaaatgctgaatactaaatactaaacagtagaagtttcacattctatcactgtcttggatgttaacaatgatgccactgtagtgcctttcctgttaaccagtgagcattgttgaaggacctggcctgggaccagggaccccctactgccttcatggaaagacttccttctgatgagtgtgagaagtgctggggcctcaccagccagggctttctgttgtcactcccctttctacagtgtgacacatctcattatatttcaagcactcttacctcactgatacatacaaatatgaatttttaaattaattaattaatgtcaagagttaaggagtctctccagctgctccaaggccttgcagtatcttgggatagggtttaaaatggatttattttgttattggaactgattaagggtcttcacattttttgtacaaaagcttgctcctgacgtattagactttgaggaagttttcaaggtttagagcctgtaactataaaaccggcaatagtatagccatgtcgtaagtgtttttagcagagaaatcatctgttaatgaggaagaaaaagatttggcctcacggaaatttatttgcctaatcctaaaggttcacctgaagcagaatcaacagtggaaacataaccacaacaggaaagggtgtgggttatatacccctcccctgccatgtttctattaatgagaaggatcaggacccaagagaggaataagaatgcaagaactaattgccatcctctttttcctttgctgcagataaacgaaggccattttcacaaaaaaaatgatcactgcagataaatgtagggtattgtcacaataaattaaccattttttttttttgcaatttaagccaacaaaagtagtatgacaagagtacatttaagtgccaagtaacctcatgctttaactgcctagatatttaaagtattattgaaatggaaatggaatgctttatttaactttgtagaggtgagtgaagttcaaattaaaatgtataaatcaccatggaatactatgcagccataaaaaatgatgagttcatgtcctttgtagggatatggatgaagctgtaaaccatcattctcagcaaactatcgcaaggacaaaaaaccaaacaccgcatattctcactcacaggtgggaattgaacaatgagaacacatggtcacaggaaggggaacatcacacactggggcctgctgtggggtggggggaggggggagggatagcattaggagatatacctaatgttcaatgacgagttaatgggtgcagcacaccaacatggcacatgtatatatatgtaacagacctgcacattgtgcacatgtaccctaaaacttaaagtataataaaaaaaagttaagcaaaaataaataaataaataaaacaaataaaaaggtataaataaccttatatgtgaggatttgatattcaatttaaatagagacttcaaaaaattcaaatgaagataactaaatcactgcttgatacatggtgcactgattaatagcataagctctggaatcatagagacttatttttgaatacccactctgtcactgactagctctgtaaccttggacaaattatttaacctttctgacccttggttatctcatctataaaatgggaattgcaacataacttactcaaaaggtataactgtggcactaattctaagacttgtattaatttaggtttgctcagaagtagaccctgagacaaggatttaaatacaaataattcaattgggagctgatcccagaaagccatggtagaagagaagatagagctgcagagctgaagatacatatatatctgtcagttgtatctcagcagggaacaaagttgagatatatgagaatactgaagaggactgaaatcaaactcaggagatgtggggttgggtccagattctgccaaaatgggaagaaagcctacacatcggaaggaagcctatacgaggcatgctaataagtatgcttatcattgtggtcaactgcccaattcactggagatttttagtgtggaacatgcattggaggtgtcctacccaaggggagaagaaggtgggatatttattgatatggtttggctgtgttctcacccaaatctcatcttgaattgtaactccaataatccccacgtgttgtgggagggaccatgtgggaggtaactgaatcatgggggtggggttttcctgtgctgttctcctgatagtgaataagtctcatgagatctgatggttttataaagagcagtttccctgcacatgctctcttgcctgctgtcatgtaagaagtgcctctgctcttccttcgccttctgccatgattgtgaggcctctccagccatgtggaactgtgagtccattaaacttctttttcctgtataaattatccagtctcgggtatttcttcatagcagtatgaaaactatgaagaccaacacctttatcccccagcttttgtccattggttaagtgctattccagagataatctcctccccagcttccagcctgctctgcaagtgggagagctactcctacaggcagagaaaggactcaggaagactcacaggtacttgtagttagacgcttcatggtttataggaaggctgagtgctaaggggaaatgggtagcccactaagggtcaaatctatcttacctgcctcgtttctgtaaataaagtgtcactggagcacagccatgtccctttatttaggtattgtctgtggcttttagtatacaatgacagagttgaccacatgacccataaagcagaaaatatctagtatcggtcctttgcagaaacagtctgttgatcccttatatagttggtagcacaactgagatatcagaatttaggcttcttgacctccaatactgtgctttcctaattacacttgagacttgctctctccaaacttaattacaggaagagatgattttaccagtgtttaatcaactagaaaactctgggccgggcgcggtggctcacgcctgtaatcccagcactttggaaggccgaggcgggcggatcacgaggtcaggagatcgagaccatcctggctaacacagtgaaaccccgtctctactaaaaaacacaaaaaaattagccgggcgtggtggcgggcgcctgtagtcccagctacgggggaggctgaggcaggagaatggcgtgaacccgggaggcggagcttgcagtgagccgagatcgcgccactgcactccagcctgggcgacagagtgagactccgtctcaaaaaaaaaaaaaaaaaaaaaaaaaaaaaaaaagaaaactctgttaactggctcttctatatgtccatatacaatgggttattcattccatagttattaccaagagacatttgaatcaaatatcctgatttggagtcttcacattaagcatgtctatatgcaatttctttcaaaaatgctaaatcgggtattgtagaacattaatgttctcaggcccagcagcttgtggataagaaaggattcacattgacatttacaaccagatttgctggctctttgcctccatctgccatgcaagccttcagacccatgcaaagtcctgtctacctaaatgattgtgaaagtctctagaggaacttatggcttttcttctcagaggtctcatccaggaacactgaacagctctgcagggcaaatactgcctggtttagtgtgttgtccatctccttgaacttctaagctataacatcctcggggtggggagatggggagtagaggtgctaaaataagatggatttccctttagcattcacagcactggatctcattggaatcccactccttgctgcacacagcagaagggatgaatttattcttccccactcactgtatgtctgtggtagtagttctcaaagcataggccagcatcagcataacctaggaacttttcagagatgcaagtcttggctgggcacagtggctcacgcctgtaatcccagcactatgggaggctgaggcaggtggatcacctgaggtcaggagttcgagaccagcctgaccaacatggtgaaaccctgtctctactaaaaatacaaaaattagccaggcgtggtggcgggtgcctataatcctagctactcaggaggctgaggcaggagaaccgcttcaacccaggaggcagaggttgctgtgagccgagattgcaccactgcactccagcctgggtgacagagcaagactcagtctcaaaaaaaaagagagagagagagatgcaggtctcaccccagagctagtaaatcagaaactctggggttgaagcccagtaatctatactttgcgaagaactgggtggttctaacgcatggtaatttttgagaattaagttggattaagaccaacacttttgatctccagtttccctccttttccccaatgtagtgatttgtgtataaatacggtgacaataaaaccttctatccccaatatgcatacccctttgatatgcgatgtggcatctcctcctttcacgagatgaagtaatttcctcatctcttgaatctgggctgatcttttgaggtgctttgaccaatataacttagcagaagtaacctacacgtttcaaagcctaggcatcagaaggtcttgtagcttccacccgccctctcttggaaaactgccctgagaataccatgtaatgaagcctaatctagcctacaggatgatgagtggccttatgaagaatcaaggttctgcaaccaacagccagctgtcagatatctgagagagtgcattttagaccatctagctcctgttcacttgctagataactgcatccacataagtaacaccaagcaagaccatcagaataactatccagctaatcacagagcaaacttcagacacacagaattatgagcaataaatcactcgttttgaactgttaagttttggggtgcttctatgcaacaatagaaactgatatggacaggtgtctaagcaacaacaattgcaagttttgctttttttttccagtatgttgatttgtcctgataattaaaacaatttatacagctcaggcaaggccaccccattataatttataatttaagtaagcagccacaaggtagtttggtttagtgttcataaaacaaaacaagcaactttaggcctcagcttctacatctataaaagaagaatactcaactagataataattgcaataattattccaagtttggatttctatggttctaagaaattcaaatagagtgaaccaattttttctacttcttaagtagaaaaaacacagaaacaggccagtcaaggtggctcatgcctgtaatcccagcactttgagaggctgaggcaggcggatcacttgaggtcaggagtttaagaccagcctgatcaacatggagcaaccccgtctttactaaaactacaaaaattagctgggcatggtggtgcgcacctgtatcccagctacttgggaggctgaggcaggagaatcgcttgaacctgaaaggcagaggttgtagtaaaccgagatcgcaccactgcactccagcctgggcaacagagcaagattctgtcacacacacacacacacacacacacacaaagaaaaaagaaagaaagaaaagaaaaaacacggaaacttgtatcacttttactccagataaatttaagattgagttaaattatattaactgctggccagctgcatctgtatctgtaattttccattaggttcttggacagagagatagtgtaaagcacagccacaaaacaaaacacaggctgtggagcttgacatgtggactgaaacccttgcttgcttgctttctagctgtgtggccttaatctagctatctcccctctaaacctcaggctccttaatctttaaaaattatctatatgttctttgcagttattttgaggataaagacatatatgttaaagctacaagtatatgtgtagcttctacatatttaatagtaggaatgcaatggaaacaatctgctataatgaattataaattctattacattgtaatacagtacatgaaataataaacatatacaagaagcataatacaaattagattttctttttttatattgcatttatttctgattaacttcctgcaagtcaggaagtcgggaatagaaacaattctttattctgatatttgaactaccacagtaaagaaaaaagaaaatcttattttaataaaagcagctctgaatttaaatgactaccttttgttttttttttcattcaacatttgtgtatttaacatcttgacttaatgctcagatctgtttcggtttgctaaagaggatgaaaagcacctgcttttgagaaaattcctctttcccttaattcttttttagctactaccacaactctgccagctatcaccaaacagctttgagctgagggcattcccagactctccatactggcagcaatgtggaggacataggagaagacaagagtggtggggggtgatgagaccctcatgttggggagaaggaagtagggcagtgctatgaaagatgagtatctctcatggcttccatcacacttcccctgacccactcctctagtctcactgatctccttaatattccgtcatcttgttcctacttcagtatcgttgctcagtcttttctctccctgcctggaataattttcccagaaatacaccaggctcacttcctcacttacatcagttttctgatgttctcttaacagacaagcttccctgaccacactatagacaataataccctcatcccatctccctgcttagttgttctctgtaatggtgtttctcaaatgtcagtgtgcacaggattcacctggggattctattaaaatgcagattgtgattcagtgggtctaggataggggcctcagattctgtgtgtctaacaaatacccattgacatcaatctgtagactacactctacagcacttataattattgagacagtatatattttcttcattagtttattgtctttctctttcaattacaatatatgttttatgaaaggagagacttttattctatgctgtactcgcagcaccagtatgatgctcaacacatggaagttaataaataaagtggatgaattatatatgttgctggaagtcaaaactggaacttccaatgtatttttcttataaacattgttacatttaggtaagttacacgttaaatggatttcggcgccctggttttggagccttcctaccatgtgtaacgtggcttatatgggacataaactcatgagttcagagtttaacaaacttataaaacatcattggaacataatctcttcatggagttacagagtctgaggctgaacctaccagagacagccagaaaacagacaccaataaatgataacataggaacaaactatgcatatgcgctgagggaaccaaaaattacagctcataaaaacaaataaacctgacacagttgagtataaccctgatacagcaatttcagtgtcccagattgacaaaaaaaaaaaaccataatgcttaagtctccaaagtcgttaaatctaactctgatgactgccgagtaatcccagagggcacatgagatgcactgtccccagattgtagggcttcttttaatccaagcactatttatgccttctaatgaattatgattgtgctaccccagctgtgattcttccagttcagtatttttctacttgacataaaataaaaatcaactttacctgaagaaccagtcaccatgctttaatgcttcaatcatttgatctttgaaaagcagacaaggcaaaaaaaaaaacaaaaacaaaaaacaacacccaaagatgtttttagttctgcctaattatggaatggtacagcaaagaagttttctggcctctttcccctgagagtcaaagccagcattaacattgccatgagaatttatgaataccttctatcaacaactgaagaggaaagaaaataaaatagactgaaaatatgcagtgaaaacaaaagttaaaactacagctaaatgaggaaatattcctcccccaagtcagcttgtggtcctcccaatccatttttctttttcttgaactaaaaatgggagagctcttaaattgtttgcaaatgggacagggagaggtgctagtaggactgtgtgtgtttctgtggtttctgtgatttttgtagacatacttgtccctcttcaggaacaatgcacacatccctggatgctaggaatattggttgttaatggtgttccttactaagaattgccttcggcctcagaaaacttgtccaagttgtccttccactctcaggcagcagccagcccctggccaatggctggctggatcaggaatacaagggccaggcccactgcctgcaattcaggacagctctgcacagccagcccagatgtagggctcctgcgagactggcttaggcctctgctgcagacaaatcacatttcagactctcccacaatctcccttgtgctcttctcttccttgtgggtgtatctccagagaacactccccatatcccgttgtcatgcaacactttgaatcagagtcaatttccaaggaatgtactctaagactttttgcacagtcaataacacaaaggtttatctctatctttagaattgaaacaaattttctctctcacccagtcatcacttcatagttgcacttttgaacaaatagctagagccaaagagaatgggatccagtatacttacaggctccaatagtggtcagtccaggagctaggtcaggctgctttgccctcagctcttgaagtaaacggtttaccgccttccactcagagctcagatcttctaacttcctctttaacagaaaagcatacacattacttattcgattaacactttgaagataattcatgaacatcttaatccatttggtgaatatattattggatttctattatattttacttctaaattaactttagtgggtagaatttcttttaaaggaattataattattttagccaaccaccctacaaatatttatcaattgctccatacaaaaaccctttctccaggcataattttatttaaaggaagtagagtgcaaacattagtgaaaacaaaccaacaaaaaacagttccctctcagcaactagcttaattcttgaagagtatctattgtggttgcatactaaaattatccagataactttaggaaaatcctaatgtactggctcacccccagtcaattatatcagagtctcttaaagggaggggctgcagtggacacgggaatatgctactcagagcccccttcaaagaaagactcttgttctagatgatggaaatgatgtcagtagacattcttcaactgtcagtcccttcagggactgcctgagctgcagagagctgccttgtccaagttcatgcctttccccaggcagccctcattcagtgactgatgaaggtgaaagtatagaggcctaatttggctcaaagcaggacaagtttgaagggctacttcagctgcagagctccccgtggcataaggcaagcctgtatatggccagtggtgtgctggtagatgtatatcaactggatctctgatctcagggtgtttaaaaacaccttgtttttagtgtttgccaatttctgtggtgtaaatattcctaccacggttaaatttaaattaccaagaagataacatcaagtggctcaaaaaatgcctggcaatataacagtaggccgtcctgagctggttccacttcactgggcagctagctatacgataatttatagccagcagaatgtgagcagaagtgttgtttgtcagtttggggctgaggctttgaaaaatttagtgaggtttccacattttttttcctttctattgctggaagcagaagactcttaggtcctacggcaaatctttacaacttactgaggagagaattaagtcctaacgccctagggcagttgttctcatactttaggatcaacagaatcacctggagaccttgctaattgctgcatggtagccccggagttctggatttagtagatactgggtggagcccaataatttgcatttttaacaattttccaggtggtgttgatgctgattgttcatgacaaaatcctaagatatctattacacctaatcagttacctgagcatttatcatagactagatatgtaccattcttgagaacataatagaccctcagatcattttcaataggatttcatcctcttgcgaaacccgagcagagaaaagctaccaagggaatggcaggcagaggaagaagatgaacaggacctaggtttctgcaataacatatgtaagaaagctgcttgactaggaaaacatacgctgggttgtcatgtgagcaagaaaagaactcctattgtgttaagccactgaaatatttagttcattacaagcagcaataccttaccagtatagtagcactagtcacaaaagctttaccagtgcctataagagataatagctgcgtttttgtatcactgtaaattcctatgcttaccttatgaggaatacaaataacttgattgatgtcgggtttggttaaaataaatacattagcagaaattgcatttctagtctgaagaatcagagttggaaaagagccagaaactacaaactctttaaataggaatggaatgaacccaacctaactggaatgtttcatatacacgttgtagtttaatgctaatcattaatttaatgcgaatcatttcaatgaaaccattactttatttattccagaaaaataattgttcaggtgctactctgtgccagactttgtgccagttactaagcttacaaaactgaagttcgtaacctctaagcattcacagacatgtaagtaaattagaacagagattttaggaaaaaataatgatttcaacaagacacctcgggggaacagcttaactcagcctggagaggtcaataggttacccacaaaagctaacatttgaatttattttgaaagacgactaggaagttttcagaaggggccattcaagcgccaggtggaaaaagggcatttcagacagaaggaaaactacgtgcaaaatggcaagaggtatcgagccttaaaaaagaaatgcagtgtgtcctggctatctagactacagtgtttacaagtaatgatacagagctgcaagaatgcaatttattaagaccttgtaatgtgggactattacattctcttctaaaaccacagagtagatggaagtgtttagagaagaagagccatatgatacgattcgtgttttgcattgtggaggctttatcagaagggtgcagagatacaagttgggaggctaacatggtaactggagtgggaagtggtcagctggactgaaggctttggccatacagaaaaaggcagaggggtgtgtgtgtgtgtgtgtgtgtgtgtgtgtgtgtgtgtgtgtgtgtgtatttttcttgcctttgatagttgagattttgagctggtaaacgacgaagagaaacttgccatcaaattgtttcttccagttgtgggatatgatgaggtttctcttcaaataatctgatcaatcttttattctttaattcatagtaccccctgatttttctcctttttcctttttacctttgttagatgcccaggcacacctcagtaccagctcacattcatttccttatttggaaagaggactaactttctagctcattacagacgccccttccccttcctctccacttgattttacgtgcccaccctatctaaaaaaatcaaatgtttagccaactgggattagtttagattgtacgacccaaccccagccaatggggggaaagggtacaggggcaggacttgcgtcaggaataaaggctctcatgcccctttgttcaggtgtgctctcatggcaactggccaaggaggcacccctctgtgcagaagtaaaattgctttgctaagaatcctttgttcgagtgttcaatgtcctcaggattttgagcattattcctaacacagtctaccctgtcagcatgtgtctttccagtcagactatgtgcccttcgcaaggcaggactgagtcctctatgccttgtacgatgttttctttatatccagtctagtgcttcctaataagaggagttcagtaaatatttctgaattgaataaaattaaatgaaaattgctacttgaataaaggaaaagagaaagagataaataagtttcttttcccccaacttgacttcaatgtgaactacataccatggatgactttatatatatatgggacttgaaggagcctatgtaggttttccaggcgtgcaatcattttattaggcttattttttcttttgagacagggtctcactctgtcacccaggcgggagagcagtggcaagatctcggctcactgcagcctcgacttcctaggcaatcctcccacctcagcctcctgagtagctactcagtactactactgagtagtactactgagtacatacatttttatgtagagacggggttttgccatgttgcccaggctggtctcaaactcctggactccagtgatctgcccatcccagcctcccaaagcgctggaattacaggtgtgagccaccacacccagccttattaggcttttataaatcctgaaccaaactgtatttaaaaagtaatctcatagactagggtcacaaattcaggtccctatagggactaggttgtaacaaagggaagaataagccttgtctaaatcagagagctataacttcagatgtggctgctgactgccaacagaaaggtgggcataagttaaaaagcaaaacacagaaaaacaaacaaaaaaccctgctgatcatattccctcaccagtgtataccggagaagtttctctcacattcttaaggtcataaggaagtacaagaaagtttgttgctgcattgtggggaattgaggccaacatgggtatgtatgtgaaagaaatggataagggtatatgtagagcaatgtggatggatttttttcttttttttttttagatggagtttcactgttgttgccctggctggaatgcagtggtgagatcttggctcactgcaacctttgcctcctgggttcaagtgattctcctgcctcagcctcccggtagctgggattacaggctcgcaccaccacacccgggtaatttttgtattttgtatttcaccatgttggccaggctgccttgaactcctgacctcagatgatctgcccatcttggcctcccaatgtgctgggattgcaggcatgagccactgcgcccggccatgggtggatctttaaaacacaattatgaatgttagaaaagctaagaaacaagatttatagcacaatgtagcttttataaatttaaaatatacttataaataatatattttaaaaggataaagcaggaaagaaacaggaatagagatattattgtcacatttcagtaattttgctaatcggttattaaacataaccattaatataaattaaattttataaatataaaataaactgtgctaagaacaaaagataatatatagtaagaattcatcacttcctaatttaactatcatcagtgctcttgagactatgtctattgtgtctgacatcaagtcaaatcaaggctttcaatgtttttatccagaatgcatgatgtaaatatttactagcatatcaataaatgtaacttttttatttattaaaaatcagtcttgaacccaaaagcaaacaaaaaataatgcctctgattagtcaggaaaaccacccttggaagtcatcactcacggaagatattttcctgtcctgacatcagaacctaaacactaaaaattaaatattctaagagactagtgagtaatatatttgatcttctggtttccctgtgaagtttctgtaaccctacaaagacagaatactaaaagcaatgagaagtaatcattctgataacagaaagtagcaataggagacaatgaacatgaaaaacttaaaactgagaaatgtggtaatcttagtcatttatcaatgaaatgacctttcaacatgggatgaaatctcatcctacaccatttaatttataggaaatcacctatatgtgctgagatagagagaaaaggagagatagtgatagattagggattgatttaaatactgctgggggtatgcccatctttccactcagtaagcatattgcccctcagaatgaggataaagagagatcaaagtttgctgtttctatgtttctaccagttgacttaggttccactctcttctcatggtgtaagtatctcagtgatttgagttagctttaatacttaaaggtatgtatttatcttacagtctagcttctaaaagcaaattaaccacttcaactgggtctcaactgaagaaagggtgctttgaatttcatgttcctcatataacactgtatcactaaacagagcaaaaattgatgtgataacgacacccctgaaaattaagaaaagttaatttacattgtgatttagaatcagaagtcttaggtttcgttcctaattcactactactggttgtgtgatccttggaaaatgagatgggtcactaagatttatcatccttgaaacatggatataataataccacctaactcatagctttgttggagaaactaaacgagatattttatatggtaaaaatgctgtgaactacaaagcactataaatttgttggttagatattatgcgctgctcaatgaagcaaaacagaagatattcaagaaaagttctcattaaaatagttacgataaaatttttttcagtgctttattaaaggactaggttttagttacctagaaaataacatgtttgtacatgcaatttctcttttattaatacataaactctaaatagtctgtccatttactctaatattatctttcccactcttatttccagataggtaaatgaggggttactataatctctaatgtagaggtggatttttaaaattaaatggcactaccaatgtatcacaaatgtctgaggacactgcaatgggtcaaaggttcaataagctcagaactgtataatttccaatcttttataattattagcaaatacttatgaaatgactacagtttttgatttggctgttcacaaaaacaatcttgctactttttcaagagtttggtgtactgtagagttgaaatggattatttatatattatacaagttcttttttgttttgcttcattttgcttttcacttctctggcatttgcccatattttcaattctctcatcattccaattaagctgtaaaattcatttgcataacaaaaaatgtttggctgtagcaactagtcaggtgttcatcatataataaaatttaagcagtgctcaatagaaatctgtaaaaggtaacaatttgcaatacatgttaatcatctataagcaaatttaaggaaatcaaataagtacttaaatcccaacttatttaaatagcgtatcagtgggataatagttatcaagtcctattcttgactacatctccataattttaaaactttgaatatgctaactaaattgcaggtccaaggttttccgcacaagagctccaaactcaacagagtgaattcgtgttctaccaaaatggataaactttgggaattcttttgtttgtaaatggaaaaatcagatttattataggtgacttttgcagctgagcattattctccattgtatatactttgcttgaaaatattcattaaatgttaagacaactatatcaaactatgaaatttctgctttatgaagaacaggaattagttacaagaaaaagtgatttctgaatatagctttccttttaaaatttaaaatggataaatatttaaggtgatagatactgcaatcactctgatttgatcattatatattatatgcttgtatcaaaatatcacttgtggtaaaaggacggaaaaagatactccatgcaaatgggaaccaaaagcaagcaggagtagctattcttatatcagacaaaatgggctttaaagcaataaccgtaaataaaagataaagaaagacattgtataatgataaaaggattagtccaacaagaagatatttactacagtactcaatttatatgcacctaacactggtgctcctagctttataaaacaatagtactagacctaagaaatgagatagacagcaatgcaataatagtgggggacttcaatactccatttacagcactagacaggtcactgaaacaaaaacttaacaaagaaacaatggacttaaattacaccctagaacaaatggacttaacagatatttacagaacattcttcctaacaattatagaatatacattcttatcagcagatggaccattctccaagacaggtcatacaagagaccacaaagtcttaataaatttaggaaaatcaaaatcatatcaagtatcttctcagaccacagtggaataaaactaaaaatcaactccaaaaggaaccctcaaaactatacaaacacatggaaattaagaaatctgctcttgaatgattttggggttaacaatgaaattgagatggaaattaaaatattttttgaaatgattaatagtgacacaatttatcaaaacctctgagatacagcaaaaacagtgctaagaggaaagttcatagtgttaaatactacatcaaaaattctgaaagagcacaaattgacaacctaatgtcacatttcaaggaactagagaaacaagaacaaactaaactcaaatccagcagaagaaaagaaataacaaagatcaaagcagaactaaatgaagttgaaacaaaaaaatacaaaatataaatgaaacaaatagttctttgaaaagataaacaaaattgatagaccattagcaagattaaccaaggaaagaagagagaagattcaaataagctcaagtagaaatgaaactggaaacactacaacctacatcacaaaaatacaaaagatcattcactactactatgaacacctttatgcacacaaactagaaaatctagaggaaatggatacattcctggaaacacacaaccctcctagtttaaatcaagaagaaatagaaaccctgaacgctttggctgggcgcggtggctcacgtctgtgattttagcactttgggaggctgaggcaggtggatcactaggtcaggagttcgagacctgcctggccaacacagtgaaactccgactctactaaaaatacaaaaattagctgggcgtggtggtgggcacctgtaatctcagctacttgggaggctgaggcaggagaattacttgaaactggaaggtggaggttgcagtgagccaagatcatgccacagcactaaagcctaggtgaaagagcaaaactccatctcaaaaaaaaaaaaaaaaaagaaagaaaccctgaacataccagtaacgagcagcaaggttgaatatcagtaatttaaaaattgccaaaaaaaagtccaggaccagatggattcacagctgaattctaccagacattcaaagaagaattggtaccaattataatgaaactatttcaaaagataaagagggaatcctccctaaatcattctatgaagtcagtatcaccctaataccaaaaccagaaaaggaaataacaaaaaagaaagcagcagcacaaaaatagcagcacaatttgcaattgcaagatatggaaccaacccaagtgtccatcgaccaatgaatggataaagaaaatgtggtatctatataccatggaatattactcagccataaaaaagaatctcttttgcagcaacttgaatggagctggcagccactattccaagtaaagtaactcaggaacggaaaactaaataccatatgttctcactcgtaagtgggagctaagctatgaggatacaaagacatacggagtgatacaatggactttggggactctaagtggggagcttgggagtgaggtaagggataaaagactatttattgggtacagtatatagtactcaggaaatggatacataaaaaatttcagaattcgccactatagaactcatccatgtaaccaaaaaccacctatacccccaaaactactgaaattataaaaaataagcaaaatataacttgtaccgcacaaataaatatgtacaattatacacatataaaattaaaaataaaaaaaaattttttaattaagtttcctaaggtagctacaattgtggctgctttcttgcctcatattttttggatatttaaaaaatattaaatgatttttatgttttctatcattaagacaaggaaaaaagccttctagaaatagatattatttgatgtagaataagtaaggaaaaataatgtatttgtttaatacaatcataaaaaatcatttgtttaaaaaagtaaactagaatatagttttaaactctatttgagtttgagattttcaaaatttaaaaatatatcttgtgtcaatggttggcatgcaattaatatctactgaataaataaaggactctacctacggctgtatatatacaggcatacattcgaatattgtaactgaaacatctatgtctctttgtctctctctttaagtgtaactaatacaactgaggacaagaggtgaaattcaaatctctaaaatgcttccctaatttcagcatgagctactgagtacatgagacttttcactcaaatattctctcagaaaagaaagttggctcatattcaagactttatactatctcttatgtctcaattattttattcggaaccacaatgttgtatattagcctgaaataacctcaagagatgtgatgcttacataagtattctgacagaatttgcttaattaaaaagggaggcaaagaaagttgataaatctttagcaatcattcctaatgtatagcttcacaatcactcgtggcagagatcattgtaaacgagtctttcaaagaatttgttaaaaagccaaacaacttaaaaagcagaaagaatatgttagtctattgggaatttttaaaagatcacatctggctgggtgcagtggctcacgcctgtaatcccaggactttgggaggccgaggcagcctgatcacctgaggtcgggagttcgagaccagcttgaccaacgtggagaaaccccatctctactaaaaatacaaaattagctgggcatggtggtgggcgcctgtaatcccagctacttggaaggctgaggcaggagaatcgcttgaacctgggaggtgtaggttgcggtgagccgagatcgcgccaccgcactccagcctgggcaacaagagcgaaactccgtctcaaaaacaaacaaacaaccaaaatcatatctaagaaaaatgaaaaaaacagttttcctaatattttgtgaatgggtattgaagtttgggataaaaatttcagcgacagcattgagaacgtgaaaaatagctctgctgatagctggcagctggcagctagctaggccatgatggtcccagctggatgttaaaaaacactcatagaaataaactaggcagacacaaggccaccccatggccgtgtttgaaacaagacagagacaaggcctttctgctatcacagaaatgactaatatgaggcattgctgctcctttaccaacgacgtgtctagccctactttaatctcatcttctagataaacactaagatacctaatcactacattgactctgtttcttgaaagcatctaatccagaaatggcttctactttctgaattcctccttagaatcatgcagccagctgaactctgtaagaagctttttccaatgccctcttactgagatgcccacactctgaagtgttttacgctcttgctgcaataaggtaaatattcttaattttttgattacagatatgttgcttgtaatcttggccagagggctttcagagtattatgtagggattcaaacaatgccatattacaaataacttagcaaggtgatgagctctacaattctagaatatacatacgaagggtttgaatgaaattgtttcataaaatataaatgtgccaggtatttctaaatgagtgtgttattttataaaatgtaagactgcaaatatggaaatgctactcaattaagaaattgaatataattagacatttgacaatctcatccatatttctaaatgtttatgtttacaagttgcccaaaaatctattataaattttttctcttctcattgggaaagtgaagctctcctcaagtttatgcattgggattagcatttattcaacctcttatactccaagacttttttttcagttgtaaagcaaacttgtatttatttatttatttatgagatggagtctcactctgtcacccaggctggagtgcagtggcgtgatctcagctcactgcaagctctgcctcccgggttcatgccattctcctgcctcagcctcccgagtagctgggactacagatgcctgccaccaagcccggctaattttgtttttgtatttttagtagagatggggtttcaccatgttagccaggatggtctcgatctcctgactttgtgatccgcccaccttggcctcccaaagtgctggtattacaggcgcgagccaccgcgcccagtcgcaaacttgtaatttaaaaaaataaaatgttgctatgcatttacttataaattattaaatgcctctaatattgttatcttctttctagaagtcctctcccaacttattctggtgttattggcatggaaattgtgctcaataaatgagtcagtcaaaatagacttgttcatttcaggggacaatttttgtctgttatctctctattgatttctgttgctacaagtgaagttacaccaggtaaatgagattgtacgcatggcagatgatttatgaaatccaagtattgttttaagtgtaattatatttatttcggcaacatttcgaccaatgaaataccatttgacctgctataccgtggataaatcttgagatgcacatcttttgtgagtaatatattaaagattgttaggcaaaaaataaaccctaaggaagtttttaaaaatgttaagatgttgatgttggcagtagaacaaactcattgggagaaaaaaaaacagcttcatctagttaattaacaacaaaacagctgggaaaatgaatcatccctggttgtgactgactgtaattgaaaatgactaatgatgctgtcattttgcagttcatatctgaggaaatgatgcctggaagattataattgccctcttgaccatttgtctacagcaattattttgtgttaaaggttgggatggaacgctttggccaaatacagaaagttcctcacacctttttctgttacattgaaaaataattcaagagcagtaagtaaaacatattactaggtttgtgtaagtaacattttttgataatataaaaagttagcaaagcaaaccagctggcttcattttatcactttagaaagtaaccaagacatttaaaattccattaatgctctcagttctaatacatggcaggtgatgtaagcattgaaagtacataaacatatttttaaaagttaactgaaagtgtagttttccaacttaagttaaaaatgagtatgaatacaagaaaatggcacctaaatgcttaagctcaagacagttaaaaatacaattttataataaaaatcaaataacaaatggcttcttttgtagtttatattgttgttactgatagcagttgtttttgctgcttttaaactgctaaatggggtgctattgaggacctagttattactgtgtggaaaaatggaacacattaaagactatttcatctatggcattaatgtaatatattataccaaaactataactttagcaaaattttaaacaatttatataactcatatagtcagtcttcagtaatttctgaagttaagatgaagaaataacatacaaataaataaaagtatgtgtgtagatgggggaggaagggggagagagagagagagagagggagagagggagagagggagagagggagagagggagagagggagagagtggagagggagggagggaaagagagagagagagagagagagacagagagagagaaagagagttgaagtgctaaacaaagatggagaggtatttgatcatacgatcctaagatttttccagttattttgcagcagagattagtactacctatacgtcattagtattatcatttcataatatgtatttgaccttttacaggaagtcctcaaagaaaataaagaagttggttagtcagagattttaaaaaagaaaccagaaatataccatctttgaaaataaaagaaatcttaaagaagttgacgaagtgaaggaaagaagaaagaggaaagaaactgagcagggatgaacccagcttccaatcagaactcagcttgggaggtgagcgtaggagctggacagacaggctgtctgatgcagaatgcggaggtgccaatagacaagtcaatttcctaagaaacagaattgctccctgatgtgtctttaattagaatgtttgtaagcggtggacacactaattatgcatttaaatactagatcttgcatatacatcgtgagagattttcattttctttttaaagaatatcattttcttcataattattacagtttccaaatgcacctcccccaaaaaacaaaaacagaaacacaattctctcatgaaaatgtgctgcaggctactcagactcatttcctcttctattaagaggtaacaagacccagagtgaagaagaggcattataaataggacaaattttaaattttgatatatggactcaaagtttaaaaaggctttgttcacgttctatcagagcaatggagtgtccttcagaaaaatcatctctaacctttaaaaataaatttttgatccatgcagagatttaaacagccctcacagctttctgccttgtattgctgggtgtcatgttcaaaactgtgaggtcattttttgagcctctaggtgtttcaggctaccgcaaaccccagctaatcttcagatgtttccaaggtcatggtccacagcaaaagttgtgcgtgagtcaactatttttttaaaccccataattctcaaatcattcttgcatttttgcccctatcaacttgatatatatatattttgagacggagtttcgctcgtgtcgcccaggctggagtgcaacagcgcgatctcggctcactgcaacttctgcctctcgggttcaagtgattctcctgcctcagcctcccaagtagctgggattacaggcgcctgccaccacagctggctcattttcatatttttagtagagacagggtttcaccatgttggccaggcaggtctcgaactcctgacctcaggtgatccgcctgcctcggcctcgcaaagtgctgggattataggcatgagccaccatgcccagccaacttgatatgttgatttttctccaaatccaagggagaaatgggaagacaggaataaattttcccttaagttcagcttctcccaatgtgtcaaattgagagaaaatagggaaacagggaaggagaaaaaaaaaaaggaaggaaaaaaacagtgctgtctgctacaaaaatggttttaagggttgtgaaagagaaggaaagcaacagctcctggttctttctttttatttcagaaaagtaattctccttttacatcactaatgcatcagcaggaagcagatatgctcaggcatggcagatcccagttctgatctccaagtggcccagtagttgagtgtgtgggtggaggtgcgataagttagcatcaagcatttggattgttttatacataatgaaagcaaaaattttctcagtggcttttaattaagatctctctctctctcttttacaaaggcacaaaagtaaaagccaaattacatgtacctttgtgatctctaacaattagtgacaaaccttaattcatagtcatacaccataaggcataaagtctttgaggatcaacaaagagtagatagaaacgtatgcaattgtccatttgtgcactgcatggcttgctacaatgaaagtcaccatattaactgctctgagggctggctttcttcagaacatcaacggaaactctgaaatttgctgctttcaggactttgcctagctcttccaactaaatactgagcacattgttagcttatgaaaaatgattatactgggcttgaactggatacaaactacttttctagatttttggagtggttgcaatatatttctgaataaaagtatgttgatatctacagagaaacctgtgattttcagtgtctggtgtttggacattaagctcaggtgcaaacttcaactctacctaaggaaaagtctcttgtaagctgtaaggaaaacaaacaatcttctagaaatgaagcttgggccaagcgcaagggaaactaagcagcgaccttagagacagaatctaagtcatggtaatgttgtttgcaaggacaaactggttctgtataatgaggttattgacctgaactgttttcaagcagttttaaacatgaggacgaggttcattgtatccaagcctgcaacattaactgagaaaccaagactgatcaataaacagccatgattacaggatctcaggaaccttcatcataatgggagccattataattctggtcaggtacagagaatcaggtaacctactgctaacgtatatttagcactggactctcatttgcaaatggaagccattgattagctattttttgaaaactgacctggctttccatctccctccttatgtaatagcctgtgaataaatgtgacctagacttcaacatggatatggagaagaaaaaaaagtagaaaggtttatcccaggccagctttttgccaaagaaataagcaattacatgacatttcactaaaaattcttgacccaataaaatactgaagcctcaatgccgattttactcttttataagaaagagcaacaaagaaaagaaaggtcacggaccatattgtgattctttacagctgttggagacagacactatgatgcagtagcttgatttgaattaaaccaaacaatatgaaaagcatcaaggctggcaagcaaagcaataaagccccaaagaatttaatctaccttgaaggtgggactacttttgtattgatggcagcacaccaggacagaaatgagtcctttaaagcaatgactcgttaatagccttaagatcacaatatataaataggatatgctgatcaaaaagacagctttgcctctgctattacagtatggccagtatttccttacaagttatttcactgattataaatagtccacgtcaatggcaaatgtacaacaggggaagcataacccattatgaggtaatggatattgctagaggttgcttcattaccttcactggctgagtggctggtttttccttgtacaaatgctgccctttagacaaaatctcttccacatccggttgtttagcttgaactgctatttcagtttcctggggaaaagaacccatatagtgcagattaacttcacagttagcaataaaattactaaatttaaatatacccttggagactccacatgtattgcagatcaatttctgcctggtacataagggcacaaaaatgtagcttttggtgcagagaaaagaaacagagatgtgaaacacattaaacttaaaaaaaattcatccaatatcttcttgaattatataatactcatatagaaacacaggcattaactacttttcaaaaaagtaaaatgcaataatgacaatacaatttattaacataatttatatgaataaacactagttttagctacaataatctcaataatcctaatgttcattttactttatacacttattgttttacaaaattctgtgtttagtattggatataaattttgttttgaaataaatatcaaataattatttctacatcactgtcaaaattattttctttccaaagggtaaacacttaaagcacagtatcaaagcttattatttattaatgagtcaaacaggccttctgaagaacgattaattttgtttattatttgcttttcttcagtctggagaaggctgaagcatgacaaaaaaaaatccttcaggtatatgaatataagcattttgttactgtctgctgactagctctcttgatgagacgacaaaagaattgtgcagaaattgaagctgaaggaagtgaagttaaatattacagaagactttttggatggaacacttgttaaacactaggatagagtatcaattaatcaatgtcaggcatcagtcagggcctgggcaatcttccccagagagcagctcctgattaacccgtatctctcttcctccctcccctaccccggagcctcccagcactgctgtgtttaagtgtctccgtgccactgtttccttcgtatactgtgtttgtacctgttccctctcagttcattagtaggaaatcccaaattactataatctcatactgcccagtacagtctcttgcaatttacgggtgctcagcacatgctcttgagatagactatttttttccagttcttattataataaataccagcagcaaacaggcactttggtcaaaattgtacataactaacctcatgtgttaatggttatgtatgcaaatttcacttcctttataacagtagtttagctactttacatgaagaactattaattgatggtcttactgccccttgccaagaaaacacattgttccctgaaaatgcagcacccggaatgactgtatgtctttgctagaggtagaaatagctctgatctcagatgaggaataaggaaaatctagttttacttactgaattccaaataggtccccagccactataaattcacccttgaataccgcatttgcaaaaaaacattttggtgtagtaaatggtgatatggtctcaaaatactttaagagaaaataaaatatattattctaaggaagtagagaaaagagcatatcttcagcaaggtaaaaatgatttaagaaaaggaaaaaaagtaactgaattttcaacctatacatttatcatttatgtataccataaattaccaggccaaatatacatgtacaatgtctaaattatacatttgaaattatatatgcattacacatataaactgacaagttaacttaaagcactgtcaccaccattcattttgtatgtgtttctctaagacaaagcactattttctatttattcactgacagctgggacttttcttgtgatagttattgatatagctaattactggtaatagacaatgttttctgattagcttcatcatagctgtagactatattattgatgatagcatagttaccattcgtataatgactactatttgccttccccaaccctgattccaacagattgccactttacagataagaaaatgaagcaagggtgggtgggatagtagtgacggtagtgacaatgatgtgaatagcttgcccacaacctcgtgggatgtgggagagttaatattcaaacacagctaggtctgaatccaaagtttatactattggcagtagtaacagctacgtcttcatatcttacaacaacttaataacatatccaaatgatttgatcaaattatgttatttctaagcattaagaaattttactttcaccatctgaatctgtttgatattatcacatatgctgaaaaacatgccctacctctctgataatagagaatcactatgggtcagagggagacaggcaacttaatgcaacagtcgtcattcccattcattggaatttttgaaaaatgatagcaaagaccattgttcccactgccaacctacagtcttatttaaactgttccaactcctttgcttcctccttcaaaacacatcacaattaatcacattatgtgtatatgtatagttttgaccattcctaaagaattatcctctatgagagtaagacccataactaccttgttcactcatatccctggaagtgcctaacacatagtaagtgctaaacaaaaaaccgttgaacgggcaaataaatactgttgcaactttgagcctatgggaattgagttaagagtgtgtattactagagacatttgttcacgcagacagtcgaaaggttcatggcatagactattttctttctaaataatctgctagagttaaatacagagtctactcttctgcttttggatttcccgtaatgattttttttgcaaaattttacatcttcacgttattgattacaacaatgtctcagaaaactcatttctatgacaaattaaaatgggattattttatacttaattaatcctttcattgacttcctttaaactaaaattccatttatcccacatttttcttcttagctgaatttgtataatttaatctccatctagcaatccaagagaacatcacaaatacaaatgttttagcatttatatgatttagcatgaatattttatataaccaacatctgaatgtgggacctctaatcaggtactttataactattgcacttgaagcatagtaaacatttattagttttgatttgtaattccagtagaagagtaaacttggaaaggctggaggatcatatttcctatacaaatctaaaaacttctatgagtattaaaacctgtgatgtactagcatggaaaagctcatctttcctttcaaacactcccacttcacttttctttttcactcatcgagcataggaagtcaatattctcctcatattcccttaaatttaatgtgtccctctgtcccccaatacagatcatttgtatttgatacatttgatctaacttttgttttcatagtatttatacattaaaaccttttgcactgaacaccaaactacttatattattccaacctttaaaaaagatttatatttctaaaattggagtgcgtattcaaaagatacctgctgcatcatctattcaatatatttataagctagagattgggatacagcactagaaaattttcaatttacaatatgaatatatgtgtgtgatatacatgtatatacatatatgtgtattagatatgataaatacacatatcaacatatatgtataatatgcacatataatacacatacacatatgtgtgagtggatatatagacacatgtatgtatatgtacaggtatacctcattttactgagttttgccttattggctctgcagatactgctttttttttttttttttttttacaaactgaaggtttgtagcaaccctgcatcaagcaagtctatcagcaacatttccaacaccatgtgcttacttcatgtctctgtgtcacaatttgataattctcacaatatttcaagctttttcaatatttttataactgttatggtgatgggtaatcagtaatctttgatgttactattttaatagtttcagggtgccacaaacagtgcccatataggatggcaaacttaatccattaatgtatgtattctgaacgctccactgaccagtcatccccctacctctcttcctctccttgggcctccctattctgagacacaacaatattgaaattatgccagttaataaccgtactatggcctctaaatgttcaagggaaaacaagagttgcatgtctctcactttaaatcaaaagctagaaatgattaagcttggttaggaaggcatgtcgaaagccaagagaggctggaagctaggcctcttgtgcccgttagctaagttgtgaatgcaaaggaaaaattcttgaagaaaattaaaagtgccagtctagtgaacatgcaaatgataacaaagcagaacagccttattgttaatatggagaatgtcttagtggtctggacagaagatcaaaacagccacaacattctcctaagccaaagcctaatccagagcaaggcccaattctgttcagttgtatgaatgctgagagaggtgaggaaattgtagaagaaaagttggaagccagcagaggtttgttcatgaggctttaggacgaagccctctccgtaacataaaagtgaaaggtggagcaacaagtgctgatggagaagctgcagcaaactatccagaagatcaagctaatatctaagatgatgaaggtagctacactaaacaacagattttcagtgtagatgaagcagtcttctattggaaaaagatgccatctaggactttcatagctagagagaagtcaatgcctggcttcgaaagttcaaaggacaggctgactctcttttgaggggctaatgcaattgatgactttcaattgaagacaatgctcatttactattccaaaaatcctagggcccttaagattatgctaatagactctgcctatgctctataaagggaacaacaaagcctggatgatagcacatctctttacagcatggtttacttactgaatattttaggcccactggccatacctattgcacagaagaaaaaatctctttcaatatattactgcttgttgataatgcacctggtcagccaagaggtctgatgaagatgtaccaagagattttgtttttatgcctgctaacacaacatccattctgcagtccttggacaaaggagtcatttcagctctcaagtcttattctttaaaaagtacattttgtaaggctatagctgccctaggtagcgattcctctgatggatctgggtaaactgaaaatcttctggaaaggactcaccattccagatgccattaagaaaatttgtgattcatagaaagaggtaaatatcaacattacaaggtgtttggaagaagtttattccaaccctcatgaatgcctatgagggtccaagactttagtaggggaagtcactggatgtggagaaaattgcaagagaactagaataaagtggagcctgaaggtgtaactgaatggccgtcatctcataatgaaacttcaatggatgaagagttgctacttatagatgagcaaaacaaagtgttttcatgagacagaatctactcctggtgaagacgctgtaaacaatgttgaaatgacaacaaagggtttagaatattctgtaaacttagttggtaaagcagcagcagggtatgagagccttgacctcatttttgaaagatctactgtgggtaaaatgttatcaaataacatcacacactacataaaaatcttttgtgaaaaaaatcaaccaacatagcaaacctcatggttgttttattctaagaaattggcatagtcactccaacctttcaacagttactactctgatcggtcagcagctatctccgtcaaggcaagaccctccatcagcaaaaagattaagactcattgaaggctcagatgactgctagcaagctttagcaacaaagtatttttttaaataatttcaactattgttttagatttaaggggtacatgtgcaggtttgttacatttatatatttattgggtgatactgaggtttggagtatgatggatcctgtcactgagatagtgcgcaccgtatctaatagttagtttttcaactcttgccccttccttatctcttcccctactagtttccagtatgtactgttgccatctttatgtccatgagtgcccaatgtttaggcccacttataagtgagaacaaagtggtatttggttttctgttcctactaattcatttacgataatggcctccagttgcatgcatgttgctacaaaggacataatttcattctttttaatggttgtgtagtatttcatattgtatgtgtaccacattttcttcatccagtccaccattgatggtcatctaggttgattccttggcttttctattgtgaatagtgctgcagtgaacatacaagtgcatgtgtctttttggtagaatgatttatttacttttggatatatactcagtaatgggattgctgggttgaatgacagtgcattttaagttgagaaatccccaaactgctttccacagtgggtgaactaatgtacactcccaccaacagcgtataatgttcccttttctctgcagcctcaccaacatctattgtgttttgagtttttgataataggcattctgactggtgtgagatggtatctcattgtggttttgatttgcatttctctaatgatgagtgatgtggagcattttttcatatctgttagccacccgtttgtcttcttttgagaagtatctatatattcatgtcttttgcccactttttacatggggttatctgcgttttgcttgttaagttccctatagattatggatattagatctttgtctgatggatagtttgtgtatattttctctcatcttgtgggttgtctgtttactctgttgatagtttcttttgctgtgtagaagctctttagtttaattagatcccacttgttaatttttggttttgttacatttgcttttaaggacttagtcatgaattctttctgaaggctgatgtccagaatagtatttcctaggttttcttctgcgattcttctagtttgagattttattgtattgtattgtatttatttagggacggagtctcgctctgttgtcaggctgaagtgcagtggcgcagtgcaatctgggctcactgcaacctccgactccctggctcaagcggttctcctgcctcagcctcccaagtagctgggattacagggatgcgccagcatgcccagctaatttttttgtatttttagtagagacggggtttcaccatgttggccaggatggtgtcaatctcctgacctcgtgatccacctgcttcagcctcccaaagtgctgggattacaggcgtgagccaccgcacctggctgagattttatttttttaaatctttaatccatcttgagttaatttttgtatatagtgaaaggtaggagtccagtttcattcctctggatacggttagccagctatcccagcaccgtttattgagtagggagtcctttccccattttttttttttttgtttactttgttaaagatcagatggctgtaggtatgcggctttatttctgagttctctattctgttctactggtccaagtttctgtttttgtagaagtcccattctctttgggtaactgtagccttatagtatagtttgaagttggttaatatcatgctttattcttttcacttagcattgtttttactcttcagactgttttttagattcatatgaattttaggatagttttttataattctgtgaaaaatgacattgctagtttgataggaatagcattgaatctgtagattgctttaagcagtatgtccattttaatgatattgattcttcctttccattaacatggaatgtttctccatttgtttgtgttatctatggtttctttcagcagtgttttgtagttagccctgtagagatctttcacttctttggttagatgtattcctagatattttattttttgtggttattgtaaatagtttgcattcttgatttggctctcagcttgaacactgcaataacatatttttaaattaaggcatgtacattagtttttaggcatacactattgtatacttaatagattacagtgtagtgtacacctgacttctatatgtaccaggaaaccaaaaagttcatgtgactcactttattatggtggtctggaactgaaccttcagtgtctcagaggtatgcctgtatatgtgtatacatatatatatatatatgtatatgtgtgtatatatatgtatatgtgtgtatatatatgtatatgtatgctatgaagaaagattaaaaagagtaagtagagagtgacagtgggctctattttaggcaatgtgagcacagaagactgctcctctcttcaggaaatggaatgaagtgaagaaatgagtcatgtcaacatactgaagactatttcaggcagagggaaaagcaagttccattgccaaaaggcggtgaggagttttgcttgtataaggatttgaagtagtacaatgctctgttaacataaatatgtacagaatcattcaggtgttatagaggacagaataaagtctctctctctctctctctctctctctctctctctctctctctctctctccctctcctcccgtccctctctttctctcaagttgattgtatataccaagagcttagtactttgtaatatttcttggataccaaccctgatttgactcttttaagatgataactctagcggcagattggaggcaagattttaaggataaggggctggtggaagaaacataggaaatgcctttagaggtccgagtacttattgaacaaacaggagcagcacggatgttcaggaagtattattcctatgttgtggataaaggactggcaggacttgatggggaaaaagaaaattttcagaatcaccaagattttataacttgggagaaactgtctaggggtacagggaagacagaggagcctgtccctatatggaaggaataatgttttcaggttggagacatgagtcaagatgcctgtgattaacactgatgcaaatgtacagaaagtaattgcaaaaagaagcgtagtgtgcagattaggggtaaggctaagaatacaggtttggaggtaaaaatagtagttggacaatattgtcccagtgatacttgtagagtgactgaagaggatagagccagaattaggtattcgcctccacaggataagagaagaaagttgaaccaagaaaagatagaaagagcagaagagactgaaacaagaacatgtaaaaacccaaaatagaagtgaggagagaattatatgaaaaggggtgccaccatgttacatattacagataagcaaggaagctcaagaaataatacaaataataatactgaatatatccttcattggaggttaaatgaaataaggttttatatccaatgttctcggtttactttgtaaatactagctcgtggtcccccaaatttactacatgttcccatttttaaaattcagcaaacagatttaggtaacaacagtaaacttactagatatatcttacaatgggagcaactataacaaggtgagtaaaacaaatgaatgggaacgtttgctctggaaaatcaagaaatacacacacacacacacacacacacacacacacacacaatctttaaggatagttattaattatggaagaaacaaacctaaaattatgagagtattaattcatcctatatgataaaaattcttaacattttaaaaaagtcttgcaacactgtaacaaattcaaaaggctggatatttcttcctttaaaattgcttacaagtacaatccagtgaaaattctgtacctttagaaaatgaacagaaatagtcaaaaatttcatctgtgtttcttgtgtgcagccaaatgactagcatccttctctatccactccatattcttcaatcacccataaatagttccaaaaatcatgaagaatagataccactactcagaaggcactggcagatagataggatcaggagtctgctttgacaactacaaggaatttccttaagacatccacatacaaattttaattaataaaattgttattggcgaataaacagaaatggcaacaaggctggcatttgagtagtccaagtattacttagagctccaaagtactaagtgggtgcttgctacatgatggactgaagagcaggtggcatgccaaatgaaatgtccatatttttcacttgcaggaagtagaatattccctgttcaagtcaccaaaatagccctagatttagtcctctggtgaatgaacattgcatactcacatcatttccctctattgaaatgtttcctattaccgtgtccttctatcatcactattgtcatcttttcatccttcaatgacatagtacagattttaagtacccatatgagatttattctcagttctatagaaacagagcaatgggtgaaagaattcatttcagctctaaattctttgtggctacttttccttggcacatttttggagaactggacctctaattaaatgcacctttgatagatcactttagaaagaccattttgaagataaatttctacaatttacctcactacatttatttgcaggttgaatttattagttcaaagataggtcagttattaagggcaagatactattgcttgaagggtcaactgtagtaaatccaattaacttcactgaaaatattctttcgtacatattttcttcagtgagtataaggaaaataaactgtaagaaactgacaattatcctaaaaattaaagaatatgtgaaataaattgtaaaatttgttatttctccatgcaaataaaatgtgacatagaaaagctaaaaaacaaagcaagaaacaactccaaagaaaccacatgagatggaaagatcagaaaatgctactaaaattattagctgtgctgaaaatggcaactaactgctatagtgatattaactgctgtgataatattaacaagctacagttgctaaaacatttattatatgtcaaacactgtgcttttcatacacacatacactcctacaaagaaagttttatctaatttcacagatgctgcaattgagagagattaggtcaattatccaagaccatgtggcttgcaaatggcagagttgagattatatccaggaagtatgtgtcaccaaatctctatttccttctttctgaatctgttgtgtatactgtgtgtgtgtgtgcatacacgcacatgtgcatatatgcttattatttctttccaaaattgacgtttcttaatattatgttaattatttctcctcctcttgaactcaaatacattctacaatattcttccagaatataaatgagagaaaatcctgtcccttctcacaaaaaatgaaataaagttttacatagccttgtaatagctctgagggtttctcttagtgggtttatgattgccaaacctctgatatccaggtcagagaactggtttgagcaaaccttttatctcgcaaatggcctcacatctttatatgatttcagataaggtgaagaaggccaccactaaaatggaaacatagctaattatagtggccggcttgtgtaaggagaaagtgttcaacttcaaagaacattcagacaagaaagtcgtcatgggatttccaccaaaaagtctcatttctaataacagaacatttccattaaggtttttttttcctccatgccttattcttaatgtcccctccaatgcaagattgtgtaccaggtgttaagatccttatgatacgaggagagtttgattttcttcatagtattgatagttcactacaatgtcaggtataattttaagaaaataacttgtattaattaggtaatagggagtaatggttcaataacagtaggagaatttcatggtctcttctgaaatccagccctgataggtttttgaaatggagtaactctaagcacctttacttttatttatctcttattaaatggcattactaataatgggcagttgctgatctgacaagcagtgaagcaaagattagtgatgaaaagaggtagaaaaaaaaaacccttgagggtaaaagtagcaagtcagaggcaaattaatatatatttacattttctaataattgatttattcaacatatttctaattctacatcatgccgattgtgtgtgcgtgtgtttaactagaaatttggtgttcttagaaatagtacaaaaaggaaaaaattcttccttgttttcctttcttgtactcaatttctttaaattttcattttacctactaataaccttagaatatatgattatatatatattaagaatatatatctcaaagcacattataaggaggacataaacaacctttccatgtatgttcaaacatttatttatttatttatttatttatttgctcattcgacaaacatttattcagtgcttactatgtttcactggggtaggaatggggagtgcagacacacaaatatatactacatttagagcaggtcaggtataacaactagtaaagtgcaatgtataatggagcacagagcaggaactgatcacttttgtgtttgatagacaagaaggtcaggacagaaaggctgggagcagaaacagctcatgcacctcattataaggggatggacggcagagagaatgtattccaagagggaacatggaacatgcaaagacaggaagcagaagaagtacggagctatcacgtaggggaatgggaagtaatggagtagaaatagaaagcaaaagccagagaaaagaaggatcttgtataccaccctcagaactgtagtggagaagctacaagagttttaaataagggaatggcacttatgttttccaattgatcttctaaatatatatgaatatatatttataaatgaaggtatatgaatatgtgaataaatagacataagatctactattaatgcttggttttctaatcaaataagctgatctgaatgagatataaatattgctacagaaaaaagaaattcaagataaaaatgacaacttttttgtaaacattaagtgtccattcacttaattttttttaacttttattttaagtacacgtgcaagtttgttacataggtaaacttgtgtcatgagggcctgttgtacagattatgttgtcacccagatattaagcctagtacccattagttattttttctggttctctccctccgcccaacctccaccctctgataggccccattgtgtgttgttcccctgtatgtgtccatgtgttctcatcacttagctcccactcataacttacttacttataaggagtgccttctaccatttggctattttgtcaaccccacaattaacagtttttctatctaatctatcattgatgataagggccactattgttatgtaaactaagaaagccaaaaaacaaaaaaacctacactttgtaaacattatctattgtacgatatatctcaagttcagaggtgttgaaatactaaaaaatgcatttgggaatcaatgaaatcctaagacatttgtggatactatggttgatttgtcagttcattattattcatttcctctcttaatatggctgccctgcagtgaatatacttcccttcccattgactttgggcttgactgtgtacctttgaccaatagaccatggacagacagaagggactgtgtggcagctcttagctggaactttaaaggcagttcaagatttgctggttccccttgttcttatcttccatcatgagagaataatatgccatataaaagctgctctttccgctagggtcctgggatgagaagacatttagagcagatccatattctagaatgaaaagaccttaacttgattcatagtgtggagtaaagctgcagctgatctgcagacacatgagtgagtaataaatgtttgttgttatatgtcactggaattttgtcattgtttgttactgcagcaagagctgacaattacaatattatagtaaaacaaacaaacaatatgtgatttctgggacaaaaaaaccaaagtaagcctttaatataaatgtgccctggtcgcatatattgactgcactatctctcattccatacagaaactgtttgctaaaaagtgtagcaagaaacaaaatatgaaatggaatcaatattgtgttagagcctgatttctgcagtccagattgtcagtcagactctgacaaatgaaggctgatggatggaaaaacacaacattgttcagttgagtttctttgtctttcctctcatgttgggtgactgttcttttacttaactacaattaggtttgctagaccactgcaacacagctctctttcactataactgcatgctgtcaagtacgtgccaacctgattgacaaagaatgacaggttctctcttcccattttgaactaatcaagggcagctcaccaaagggagacttaaaaaaaaaaaacttagagatttatggatttcaaaaataatctgtccaaatatacaaagcataatgcagcattgatttttaaactggaaagtgttgtgaaactgtgaagatataatctactaagctgcatacttgaaatgttcaaggccagtgaaagagtgggcataggtgtgaccatcaagtaacatccagaagcctctatggaagctctccaccttaaagtgggggtttcaaagtctttttggcagaattcttttggcaaatgaaatattaccaaaactcttccaaaaaatcacttgagtcattccataaatattgacagattacttattgtctgctaaacattgtttgaggtactagatatgtaacagcgaataaaacagacaaactttttgtgtcctcataaaacttacattctaatggtgataatgtgtagtaaaagagaaattaaggtgctttggagagtgaaaagtgctaaagaacaaaatgtaaagcactggataggaataagagacttaggtatggggcaaagggaggtggcatgtggagagtttagaaagtgcctgcagggaaagcctcactgagtaggtggtatttaaataaagatctgaaggaagtgagggaacgattcaagtagctatctcaggaaagaacaatctgtgcagagacagcaagtgcaaaggccctggggcaggagtgtatgtgtatgttcaattaaaaaaaaaaggacaccagggtgagtggaatctagtgagcaaggggagagtagtaggaatgatagtcatagagttggggatggaggaggataggtcctgcatctttggaaggatcttggctgttatcctgagtgagattaggaagcataggagagttttcagcagaggagtgatgtgatctgacttatttttaaacagatcattctggctgctgtattaagattagactttaagaatgcagagaacagatggcagttaagaacagattcttaagggggtacaatctgcattgtttggatggaaggactttgtgaaaacctgaagccattattttggaaaactttatacatacagttcttaactaagggccaaagctctggtctggtttaatagcagcacaggacactgcttagaagaacattcatttaaactggtactcccaggtcttgctgccttcctaagtccttactggtgaagagtatgggctcttgagtctggttatctaggttccaatcctagcatgaattgactatttccaacagagaccaaatggcccatgaagcctcaaaaactgactgaaatttttctatttggccttttaaagaaaaaagttggccaacactgatgtagagaaacggttaggttcaggctctgtggctctaaaatccttcaagtatgcataattattccacaatgtaaacatatatcaaaacatcacattgtacctcataaatatatgtacttattatttgtcaattaaaataaaataaaaaatacaggggtatttttaataatcaaacattagaaacaaatgcttttctataaactccttatatagactcatagaaagagttaaacaatttataattagaatttatttgtttatttatttactattttgacacagtctcgctctgtcgcccaggctggagtgcagtggcatgatctcggctcactgcaacctctgcctccccagctcaagcggttcttgtgcctcagcctccagagtagctgagattacaggcatgcaccaccaagcctggctaatttttgtgtttttagtacagacggggttttgccatgttggccaggctcgtctcgaactcctggcctcaagtgatccacccatttcggcctctcaaagtgctgggattacaggtgtgagccactgcacctggccaatttgtaattatactttagagcagaggttagcaaacattttctataaaacaccatatagtaaatattttagactttgtgggccaaactcaaattctgccaatgtggcatgaaagtagtcaggtctaatacatgaacaaataaatgtggctgtgttccaataactctttatttctgaaaataggtggaggactaaatgtggcccttggaccatagtttgctgactcttgctttaggatattacagtgttgttggaaataatcagtctagaaataagaacatctgggttctaggcttattagcccatgagttggggcaagtcatttaactgctctaagtttcaggtttcagtatctttaaatataaaataaatgaaactaacagatattactgtgagtaaagggttaaaaacaccctttgtccatctgtatgagaatttgtactttgatcaactttctagctcccttctccctagaaaactgataaagttggaatgtcaaatgtgtgagcaggcaacattgcttcagattaaaaaaaaaaatgatggggactggtaaattacaccttggttaggtgttctacatatgaactataaatacctaatggaaaaccataattgtggggcgtccccaagtacaacaattcttgtaactaagcatgtcctttttgaggaccttggaaactatgttacaaggcattggcctctgggatgcataaggcttctaggccagggttgacccagcatctcgatttgtttccttcctgtgcacctgagatgtcatgagagagtggacaggtgctgcaaagtgaatagctcttggatggctccctgggtgcttcagagattgctacgcatactcatcctactaaagagagatacccgatgctaccttcctgctaagctatattcctatatccttctaagtgcctttgctactgaatgtggtcatagtattgttcagttgcacctaatcaaagaagacttactgttgtgttttacaataatcaattataagactcacattttatttcaacaggttagctgctctgaaattgggacacgttttataaatgatagcgtgtcatagtctaaaacggcagcacatttttcttggtgaaaaataaaataacaatgcatactctaatcaatggtatcttaaaaacagtaaaatatggaaagtgatcaggcttttcatagtaggtcaggatgaaatgatttagtacatgtaaaggtaatactgctaccatttgttggaaactgactaagtgcaaacactctgctatgcacttaacataaatcatcttaattaatctcaatctccattgcagagcctctcagcaatactattaccattttttcagattaaaaaactagagtcacgaaaggtcagaaacttgcctagggcacaacctaacatatggtgaatctgagatttgaaccctagtctttctgaggcaaatcctgcatacataattactatgctacagggtctctggatttaaatattgtaccaataaaaagtaggttttatttgatgaatcctacggctcagaacggaacaaagtagtttcgattaggatgtaatgtgagtttcaatcagggtttctcagcttcagccctattgccatttgggactggataattatttcttgtcgggagctaccctgtgtactgcagggtgttttgcagcatgcctggtcactatgcacaagatgccagtagcactttctcctcccccatgtgtgacaaccacaaatatctccagcaattgccaaattcccctggaatcatctgtggtagagaagcattctattattgaatacatgaaggaacaaatgaaagaatgtctgttcacggtctgtattttcagtgtacatgaattaatatgacatgatatgaatgtctttccttcctttctcttatatacaacattgtatgtaatgtcatctgttcatatactctttcagatgcacttttatcacgctatgtctcttaacattcatttgagtgtggttctgatgaattctaaccatcatggcatgtttcagtttctggctgaatgggtcctaatatctctggattatataccccaaaaggattagggaatacagtagatctaaggactagaaaggcacatattaaacaaaagtgattttgacatatctctgaatagtggccagtgatatttgcattattttaaaccaatatagagcatctctaagttattatccatatagtaattggacatggttctttaagtcttaacagaatatttacttaaatctgttattattaaacactagaagttgctttttaaagataaaacagccattaggctaattttcattaaaagcaaagaaaagagcaattcaattctgacttcatgactgacatgcactttaaataaaattaaagatgttttgtttttactattaggttctgtaccaaaatcatagtcattatctaaaacaactctttctaagtgctaccataactaataaactcaagcaatcaaatgggtaattgaattaaactcgtatttttttaaaaaaaaacagcaacaatatatctgcattctctcttctgaatactcttcctaaacatgtacaggaaacagcaaatatatgggtttctgaaatcaagaaaaaggacacattatgtaataaagccaattcctggtttactcaatatgtcagtcttcatctgtgataccaggtctttagactgttgcacttagcctttatacacttataactcatgatttccatatgttccactaagtagccattttcactagtctcctgaaaagtcaacgataagattttggataaggaattgtagacttatatattaggtgcatataatccagaactctactagaatctagaatatacagacaactcatattaatcggtaagagaaagtaaacaatccaacggaaaattggggtaaatatatgaagagtcaactcacagaaggaaaaatctgtccaacaaacttgaaaacttgttcaaccagggatatgcaaattaaaataataaattcctgccacttcttgctgctggtggaaaagcaatttgcaatatatgataaaattaaaaatgtgaatactctaatgaggtaacaattccacttctaggtgttctcatatgtctatctgaggagacctacagagaatgttgtttcagcattgttcattagtgaagagctggaacaatctgattattcactgttaatctaacgggcacattgattgtttggtttctattaaaatcaagaatacttttaccagattacttctgtattctaaagccattaaaaatctttgttcgtatttttatggagtccaaagttctatttaagctagtcataagcaaagttaatgctactattcataatggactcattgaagatactaaagataataaaataacaatactatctctaacaaattggactttagttacaatggcatacacagtacaatgtccaaataacatctgttcagttttgagtgaagcacaggaacgtgtatgtatgtatgtgtgtgtgcataatttgtatttgtgttatctctccaattatgtaaatcactaatacttattactatgctaataccagaagacgtattgtaataaaggtcacatgaattattaatttttgtgtttcttatcacctatttcatcaaataattttaaagacagagatgctatctatccacactttctctacttgtcattcacaaaagttccttcaaacaaatcttaaaaattaaaagtatgcgcacatggctttgtagtttcatgtttcagtaaggagaattttacttggatcctatacattattgtgagtgcttccatgttttgccttcttaatgcttaccaaaattattaatgtcaagaataccaatcttggccaggcatggtggctcacgcctgtaatcccagcactttcggatgctgaggctgacggatcacttgaggtcaggagtttgagaccagcctggtcaacatggtgaaaccctgtctctactaaaaatacaaaaattagccgggtgtggtggtgggcaccagtaatcctagctacttggcagtctgaggcaggagaatcccttgaacccaggaggcggaggctgcagtgagctgagatcgcagcactgcactccagcctgggtgatggagcaagactccacctcggaaaaaaaaaaaaaaaaaaaaaaaaaaaaagagaataccaatctcattttaatgaccagcatgttacataatcaattattataaatgattttaagctgtttaatgttcaaattaaaacttttcttaaaatagcctaatttaaataattatggatgttttcattaactatattatttgtgccctgttatgttcggtaactgccaaatattcattgtgtcaagggggtcaccaaagtgttcagaatttggaaactgtagcttcagatgtattaaacatgcaaactctacttttttatatgtatcattttgaaattacagaacaaactgaatgcatttacactaagtaataattgaagcagttaacttggccctacggtgtttccttttcaaaatatatgtcagatatatacagagaagtgtttaatatcccctatatgcacagatacatatatcatatatatgatatatgaaatatataaggaatttaaattttctatatcatgaatcacatactgattcattcattcagtatgtgaatgcatgagtctaatcccactgacactattgctcaaaggagggtcaggaagaataggggggaaaatgatgtgaataggaaaacagtaagcatatggcaattttgaagtatttggaatacaaagttattataagttgagtacagctgacaaaaaaatgcatagtaacatcagctaactttgcctagtagatgataggggtacttatataaaatagaattgtatttgttaattagaatcataatatactcttcagtgatacagaacttaatatactaagtgaaatctcagtatatagaattgtatattcaagaggacatattgctatggcatttctaagccgtaaattcaacgcataaagtttggatgattacatcttcattggagagaatcatgttactttatgatatattttcatactgataacatctaagtttattctgaattaggatatatgaagtattacttaaaacccttcagaatgttacatagttttgttagagacatgcatctttaaattattttttagataatatattattatcatttggtaatttttctcaactctcaaatatgagtggaagtttaaattggtatgagttcttgagatggaaactgaagagtgaaatagctttatttaaaatagatacttctcctaatgctaaaacttaaagtataataaaaaaaataaaatagataattcttaaagtgttctttttagtgttcaataatttatatatatgtattatatacattatagttataatggcatatacagtataatgttcaaataacatctgttcagttttgacaaatatatatatttgtctttttctccccattgggaaataaagtaacaaagattatggccacagtttatcttgcttttgtttttcctcacagcacctgatagagagttctacctgtaaacaccaagttcactccctcctccactaaatgacaatgtaacaagtggcttcaagttgctccaactttttggaaggcatccttatacataatggataatcacgcttgtttttagaggtatcataattacaaatttagaattctaagtgttcttcagcagtaactcagagatttaagaatccctttagtaactgatatagtcagcagagaaccgtatttcctgatgaaaatacaagctcagagccacaaggtcagcagggtagagacttatcaggcagacaagaggcactgttccagagagcagagggtcagaggagactgcaagtacctgcatagagatctcaggtcatgtataatgcttcctcatctgtcaacccagctgccattttggagaggagcaggaggagagcaaggaaatctaaaagactggtcattatccatgaggtcccaacccataaaaagagactggtgaaatcactatttcagagtgagatgataattttttctcactgcccagtatgggaaagggttatgaagatcactgagaaataaatgaagaagttttcattctgagaatcaatatttgactcccggacatacccatttaacttctcctgcatatttattgtatgcatgaaaatgtatctacttaagaatctatgacagtgcttttcaaactgtggttccacagaccagaaataacagtttcacattaaattttaagaagcatggctctagataggatatagtagaataaggaatggataagtgttagcctcccagattttaattcatttacatacttatggatataacacttatctttaaatgatacgactttgtgaataaacagcttcatgaatatagctttatgagacaatggagaaaggtggccaaattttttaaaaagttatgattagaagaattgtgttgttttaagtattgcaaattgcaagtgcagagcatgtctgaatgtatctgaaatcccaacgtgttattttctaccaacagtcaatgccaccaagggaggtaacttgcaagtttaaaaccttcctcatttaacttccattgtttctgcaccgcgttctgtctgccaatcaaagccatcccctgggcattatagttagtaaaccaggtggtccattcatccacttaagcagaaattgtttgaaaatgattggaagtgttcccatttttctcctccacacagaatcagaaagagatgacacccatgggcagagcagagttttctttagagtacataaaaaaaaaaaactgatagcatggcttctgacgttctctcataacttccttcaaagtattatctaaatttccttctaaaggagtagtgaaggactgctaagtaaaaactaaaattctaatatgcagtaaaagcattatttcaagaaagtataaacatatttagggtgacaaaatgactttttaaggtttatttcaaaagcaagagaatgatctaggagagagtagaactgctttaggagaaaatggtataatattggtgaatggaaaatagaaattggaaccttttaatttctattgggtttgtttcttgtatgtcaagaggaatggtattctaactgcaaagaataaaacaaatagcagtgagagggaactggtgtccaagatgggtaaagagattagaaagcccccagctgctcagaattaactctcttgatgcagataaattacatctcagtatgctaatacaactggcaagtcaaatggcaaaccattgtggttactcatgaagactgggaaagtgcagttttgattttcacaaggaaaaataagtgtgggaataaaatgttaagcttccagatagttatttcagatttggctagaaaatgcaatgcaaagagaagccacaaaccttctttaggtaatgtattttgaaagaatgggagtcagttgacacaggctctttgcaaagacaaaccctgttctagccatcaatgtattgttagataaataagaaaatgaaagcaaatatttacatattagttaaaaattttttaaatctctacttgtgctacaatttgtcatcatgttgaacttctgtccaggattgatggctaagaagagcaaagaccattcctatgcaattcaaaggttagttttgatgttttcaggttataaccttaagactagaatctgtctgttgtagaaaacattcattaaaacctttatcatagaaaaccatgtttttacttcaagttgtaaactatatttgccttagtaagaaagagaccaataacccaaaagagaacattggcaaaaaacaaaaaagtagcaaacagtgcatagaaaaggaaataaaaatgattctgcaacacatgaaaaaattcaaattcactcacaaaatgaataaagaattcaaattaaaatgacagatatcaccatttttcttgtttagaagatcaaaaaggttgataacacactgagtgggcacgggtatggggaaaagaaacctttcctaatactgacgagatgttctatgaagagcaatttggcaaaatgtactaacaagacaaatgccagtttgacgcagccattcgacggctaggaatttatcacatagatatatttgcaacgtgtaaaatgatgtgcacaaagttatacattttcttatcttagccaaaagtcgaaacaaactaaaggctcactaattggagtgctgcttaagtgaattatggtatatccttagaacagaatagtatgcaactgtaaaaaaaaaaaaaaagagacagttctttaactactaatacagaaaataatcacctgtgtgtgtgtgtgtgtgtgtgtgtgtgtatatatatacacacacacacacagcattttactcttccctttcttataagggagggagaagagtgctatacacacacacacacacacacacacacacacacacaggcattttagtctttcctttcttatgaaggaggaagaagagtgcttttccttctgccctcgccaagccaaggaaaagggcttcaaaagaaccatcttttgaaggatgcagaaacagtatttatagtattctaacagctggctttattttaagaggacaagagtagaaaataatatacacacacacacacacacacacacacacacctacatcctattcttggaaggctacccaggaaactgaaaaccttggcagcacatggggagagaaactgtgtggctgaaagacaacaatgcaacagaggatttcaatgcttttgaattttgtactggaagaaagtatctattcaataaataaacaaaattattattattattattaaagatggagtcttgctctgtcacccaggctagagtgcagtggtgcaatctcggctcactgcaacctccgcctccaggttcaagggattctcctgcctcagcctcccgagtagctgggattagaggcactcaccaccatgcccagctaatttttgtatttttagtggagacggggtttcatcaccttggccaggctggtctggaactcctgacctcgtgatccacctgcctcagcctcccaaagtgctgggagtacaggtgtgagccattgcgcctggcctatttatattatctttaaagtctgttatacagggataaatttacccccaactttgtaataattaacccagtatgacatcactgatacagtactaattaactcattttctataaaactgtgcagattatcttaaaattcgaaacaaaaatgaagtacaatacaaatgataacaacagttccagaaaacaacacttaagcataccacacgtaacacaatgtaataacctgcgttatattctttggtaccctatgctatcttattctattttattttacccattaaatggatttcataactcatcagtgggttgtaagattctctcccgggcctgaaagcttaaggagatgagtaactcctcctttctcaggcccattcctaaggcacaaggctacttgcctgagcagcatgcaccggcgaaatagcagaagcaggaagagagccggccagaagacaagtacctctgaagatcgagaaagaggccatccgggtacaatgcagcagttacgtcaggccaggagacttcctgtttacaggagactataaaacctttgtccagtcctcacttggggctaacgccattttaggcctgaggctgcccgcacccaggcgctcattaaaacagcatgttgcggccgggtgaggtggctcacgcctgtaatcccagcactctgggaggccgaggcgggcagatcatgaggtcaggagatcgagaccatcctggctaacatggtgaaaccccgcctctactaaaaatacacaaaattagccgggcgtggtggcgggcgcctgtagtcccagctgctcgggaggatgacgcaggagaatggcgtgaacccaggaggcggagcttgcagtgagctgagatcacgccactgcactccagcctgggcgactgagcaagactccgtctcaaacaaacaaacaaaaaaaagatttgactggatttgttcctgtggtaggcacttcattccaattttcttgcccactttttggttaatgacagactttcttccgctttacaaaataaaagcacacctctctgacctatcccactggtgcattgtagtcaagatacatttatgccaaataaaagtacaattcaaaatattagcgactgaaatccttctttactcaaggtaccatcaaatacccatccatctcataatagattcattttcaataactatccactgagtatgtttaataattatttatcaaaaggtacatatatttaggttatttggttattactaagtgtatttattattaatactttaaatactactcaatctagagaattttaaaaatacttagagccttgtagtcacaggaaattgtttttaaaaattgaatttaagtccacataaatataattttataaagaattatgatagagtggctaataaaactttatagcataaatatgtatcacatatttatcacattagaatacaattcattggggaagttgaaaaatatgatttaaataaaaaggaataatataaaacttctatttattaaatatgagctttttcatgtatttttaagtatatgatggtagacattatattgcaatggtatttggattccacgggatacattctaaactgtactataaacccttttaaaatgtcaatatttactgtatcccaagggcagaaaatagatgtcatctttaaaatgtgcaagcagatattcaattttctaaaatatttttattttttataaatacaatggtctgaatgccactataatagaggttctttgaagccctcttccttggcttggcaaagaggaaaagcactcttctcccctccctcataagaaagggaacagtaaaagtcatagaagttttctcatgtccaacaaattgttagtcctatttgaatgatctgttccaggaattctcattcaagaaactgttctcaagtttatccttttccttatatgggcaagttaggttggtgaacgatgaaaatctcatgaccatctactcccttttttggagtgtttttctggtaccaacttgctgctgtaggggtattttgaaggccttttttttttttttttttttttttaaagaagtcttgctctattccccatgccggagtgcagtggtgtgatcttggctcactgcaacctccgcctcctgggttcaagcaattctcatgcctcagcctcccaggtagctgggactacaggtgcgtgccaccatgcctggctaattttttctatttttagtagagatggggttttgctatattgcccaggctgatctcaaactcccaagctcaggcaatccacctgctttggcctcccaaagtcctagggttacagacgtgagctaccatgcctggctgaaagcctaatttttattgttagtacctcttaccataactcctgatacaacaagaaaggtcccattcactgtctttttctacgccttaggaaatgtgttcccatcttagttttgccttatctaacagagtcccagggaaattcactcaatttttcatttttagtgaagaagaaggtcaggttaaaaagggtaagtgagttaaacaatatcgtaaagccagtaagtgtcagcactgggattcaaacttagtcttttgtttctttccccttattattctacttcaactcagcaatggtttttggagttgagtagaaaaaacaaaaagtaagaggaagattatggtacccagtgttcataaagagaagcagatgcctaattccactaatagatgaaactatccacaaacttaaacaaacacgcttcaaggtgttatcaagccagaattatactcttgcccagaggcaacctaaactcaggagaaaaacattcaataaatctgtgttcagttgcatggtaaaagggaataatttgtctttttgtccagtaactgtcatccagtgtttttcaggacacattccactgatattttcatatccaatataaaacactgaaacttttttctaaaggtctcttccttgttccttacctcccgaacaccacttttaaaaaattttttttaaaaatgaaatcagataacaggtgaacttgagctagtacacatctatctaagggagttactatttgaatttgaattatccattctaaagtgaatttaatgacattaacctctgcaaagctaattttgtgaatgttgagtacactcctgactgattaattgggaatccattggtaagtctgactccttacccacgaaagcgtggaagcatggtaacatcagattttgattctcagtaatctgagtatattcttgagtctagagtcccaggcttctttgtttgaaaagcatcattggtttagaacatggaaaattcttattgaaatctcatttggttcaacttcagattttcagtatttagagaaatcattttctgtacagatcacgtttgtagagacctcattcatgtttcctttttttgttgttgctgttccttcggtgcctctttcctccaggagacattctcactattctgtttctcctcctctgaagactactgctgattagatgcttcacctctatggcacaaactaggcttctcttcttgttagtttgatttttactaaagatgaacttcaatggcctcttccgaaaacataagcactccctaagctggctcatctaagacctctcccttcccatcaccaccattcctccttcttcctttgactacttttgatcttccctttagctcccttaaatccttcagcatattcctcttcaaacccgtacctgctccatctctttgtccatccatgacagacctttctcttcctactccagtctctcaactctctatggtctctaaagcgttatgctccctgccactactgggggctctggaaaactcaaaccccagaagcaaccacctgaggttgaaaaagctaattggaaacagactggataccgtgtacgttcagatgggatttggagatacccagatggccactaggtatctcctcagtcatttactcaaattttagaacacagcctccataaattacatatcagggcaaaagaaaatcttaaaaggctcctccacaaatattgatgtaaacttttagccctcatattgagtaggtgaatttaacttgtattcataagctttgctagttggctatgaaatactggtatatgacaaacagttcacacttagctaattcctagttttctctataaaataagacttactaatggttaaaaatataatcaatatatgtaaataaaacttccagaaacattaggggtaaagggaaacaactttgtatgcaaaatatacaaggtatgttggatgtgtttttgttaaggaaaaagagaataactttgtcctaaattaaaatgactgtgaaaatgaggaagaggaaggtataggacaaaatctgaatgaacattggaaatggcagaagatttgtggaaggagagtcttatgttaatagccaatgctggctaaaacggaatggatttatgtgtatgtaaactcttacaaatgacccttagtatcaacagtgtattgatcaaaaatgagttgtagtttctttttgttaaaaaatgataaaatattcttggattattggtctgctcttttgaaataaaattgaatatacttaagtatgcaacatattttgatatatatatatatatatacgcacacacaaaattgcaaaacaattatttcggtcaaactaattaacattttcatcttttctattggtcttctcttaataagagattgcaaaatttgtttttttttttatattttgggtaatctgtataggaaacaaatattgtttcttatcagaataagtacctgtgttgattttgtatgtccttgaatttttttagaaagtagtgttttctctttggaaagaactaaaaacttttaccgtcatgtggccttctacatttatttttgaaatcttttattgtcatcttggttacataggtagccatgcattctttcatagtgagcaatgatcctattcagccaagtattcaaaccttttgtcattttacaacctttgatattttgcttttcccaggtcaattcttaaataaaattttttttaatctcagattggtttgaaaaatttcaaaggatttgttcctgcacccttgtaaaatgaaggatgttaaaaataactaggttcatttggtatgttgagttgcataaaaagctttgacaagaagagatgctgaaccttgactaggttatagttgtatgggtcaactattattagtataaatacttgaaaaattataataaatccttagaactttgttagtgctctaggtgctctaggtgtccatgacacatcctggtgctactttatccgataataatattatgtcatcagtcctaactccagttgttattttaaaatgtggcatggcaccagggaaaaaaaaaatttcttgtcgaatgaatcagatctttaattatggccattttaagtcttttgtcgttcacagatagtttttggtttatgctgatgcttccctgagtgctcttacaatcagttagaggtcagaatgcatcatcttcagtaaaacaggaccatctttgagacccataggaagtactacgacaggtactctgggacacagacttctgatgccattgcttaaataacttcgagattataccattggacaaagtcaggatttatgaaactctgtgaagaagctgatgagttcatgaaactactaactcaagatcaagcaagacaagaattaactacatgggcctgaatgaactgataaaagatttgattatggcttttgtttaaaatattcctcatgttttaatgttctgtttgctaaatacaagaaacgcctttcctttttctcttaagttatctataactcatgagaatttagagtatgcttttgtaaacagaatgaaacattaatctttttatccctgcctgatccctgtaaaattcagaaattcttaccgagtattcttattttcatggcaatataattatttgcataggctcaataaatatatttaggtaacaagacataattgaaaaaaatatataaccaaggctttgactggaatgtcatatttgagaattaagtgcatagagtcagatgtgaccagttttaaggagctactcttgactatatggagctaatataagccccttttgggaaaactgtcccggtacctggcttacagaattcccaatcttacaactgagtaaggaaggtctattcttaggagacccaggaaaccaagggtattttaggaacctggaaaacagaacacttcagctgaatctataggtattttacttcaggtaaaatctgatgtcaagttcttgacttgccttcctaaactttggagacttttaaaaaatcaaatctgaggtttcatattttttaaactactttattgaggtatgattgacaaacagaaagctgtacatatttaatgcatagaacttgatgagtttggagataaagtatatatacaaaaccaataccacaatctatgccataaacctatgcgttacctccaaaagtttcctctcaccttatgtaccactgctcctaaaagagagtagtagtattttgtggtaagaacacttaaactctgccctcagcaaatttctaattgtacagtacagtatcgttaactataggcactatgctgtacagtatatctctgaaacttattcagcttgtgattcttcatgaaaacttccagctaatcacacttaaaatagcctatttggtaaattaccatttttgctacccctatataaataaataggccagtcttattttataaacaaggaaagtcttactttgattaacactgatcaaaagggtgatggtagagatagagtttcagtaacccttggggttatcagattctagtcctgttcattgtctttgatctattttgcatttctttgtaaacgacatgatttttttttttttttttttacctacctgtaaattgatctggatcctgctgtcttacacattttgtccgtccttaccaattttcagtttatttcctttacaatctggctgcgattctccaaattaacatttcaaatttttctcccaccatcctgacttggtgacactgagaactaaaacgtgactgcccatattattactgagataaggactctcttctctaggttgtcttatagctgccatttccccacaatatctaaagaagccctgcaagcagaagctggatgacttgctataaactacaaaggactcaccaccacagcaaattatgtatagacaactttcatgcctggagctgctgctttgtaggccatgcaaaaagttcagtaaactccaacctcttccgtgccatgctccaagaaatccatcggattgctactgccatcctcactctaccatctgagaatgcctacagcccagcttctaggaatctttttgacttgctgccctctggactcaaaaactgagtttgcagtctgcttcaaccattaatcttcgtcttccttctaactttcatggaaatctccttcatgaaatgtctgattactaccaagtgtcagagttcgttcagctagtccttcaacaacagaaacctgctgaaatgaactagatgaactggcgttcctaagtttttcaatgggaaaactggtttcccttgaacaaaatggagggttgacaaagaaagctttaaaaataccctgagtttgactacatttgagacagatttcttcctgactttagacctgaccttccttttcttagagcatttactctagaaaactttatatattatttctctacttttttgagacaaaaatattctcctagcctcttgccacttttatacctcaggaataaactttctcaaggacttgggagctagcactttgatatagaatcatcaaaaaagatagtgccccaatctgctagtcttctgttgggaggataggaatctaactttgataagtgccaatcagcaaacacagatggcctaaataagcacattgactaacctccctcctgatatctagtactttctcactaactcatctcagcacttagaggctctcctgccttttatttcagcagaattgagttcaatctgtctcctctattgcaaaagttttgaacacagtctttcttgtctgttgtctagtgctatttttctttgacaacactcacagcaatgtgaacacacacagtgttcagtgactttaatggtcagtcactacaattgagtcctttggtagtttttagtgtggatttgacattatgggcaattatgctccttatactgcaaggaagagccagcagagccacatgtcatgtttatttataaaccacagaaggaaagtgattcttgaggggaggaaaaaaccccctccctgtgattaagatgaaagtatttcagtcactaagccttaacataaaattatgtgtcccgccacacctcatattttaataaaaagtttggaaagcagtagtcagtcttatgtcagataaatagtatacctctagctcattattgaaagcattcattaaaggttaaaaacataagaccctttatagaaattctaaactggtcccgggatcttagcattcaattatcatttctgaaatctgaaatcaacatattttatgtctaaattgagagtatatttgaaaatcaaaattcaaaggcatgccttctagtgggctgactgatgggaaagggctgtgattacgcctaattttcaccctctacatcacgatctcattgattatgtttctcagcttgctaagggttctgtgaggtgattttcaagatgaatattgctatttgcaggatttcctgaataggaatatttcgggagtaaattgcacaaaccaagcaatgtgcagtcaattttcactccagcataaacaatgtattagaacacagcccttaaagcttttttttatctgggtttcactacacagctagctgcatttcatcaataagagtgaagtaccaagcagacaaaactgaggctcacagagagagggtattacatatttttctaacaggtgtgctcagagtttgactagagaaaacaaactacccgaatggcaaggcctcagaccctttgtttccgaggcagctatggccaccatggccagacaaggcaagtttctttacatttaggatttggagctaggggcgtggctgttcgtatatctacttcctttgcattaactctttcttaagattttagtaaaggtgtttttttttttttaccttgtgttaaaaaaaagggcatgtgctcaaaactccttaaaaattttatttttggtgttcagtagtttgaaactaagtaaagcaaagtctagtgtcccatctttctttaatggaaaaatagtttaattcctttaagcagaggaatacagcaggctgtaaggactaatatcctatatcttaaatcagaaaaactgtgcaatcttaataaatcatttattagtgaaaggaatggaagctagacaaagagggataaaaaacaaggtaaattattattcacacaggtcaccatttcctaattataagctgggggtttgagaatttttgggagaaactctcaagtcatcaaatctatgattttatgtttcccctccccccaccttgaacacagccacaagcagaagaaaaaggctaaaagagtatttttgaagtctgcactccagagataagaaactcggaatgtgctcagaggactgaagccaaggagttttctgccaggaaaaaagcagctccctctcccctcagtgatttaaaacaagctgcaggaggcaaatatcatgactctcagaaactacacacagcagtgagtggtgacttgtagctttgataaagaaaagtgattaacacagccgagtatggctttcacttcaaactgcagggacccatttggcagagccctatgggccatagacaatcgaagacacaatgcaggttttcattatttgaaaaccattccggggggcacagactgggacaaaagtcattttgattgagtaaacaggatctatttgtaccaagggattcaaaaaaaaatcttttcttaaatgtgttccaggaagagagatagctagcattgagtattttttaaactattataataaagaggcacattttaaccaaagattgcatttaaaagagtagaatgtgcttttaccgtgagctacaaaaagctatttctggttgggaggaaagactttatgacctttcctcttcgcaatattacgccagttactttttaagaatatactggatataagataattgagaatttggctaaggttattgtgtattgggccaagtaactgtactttcttgttggggttgtttattgagcagtgaaaaatcagtattcatgagatgtaattgtactggtgaataggagctagtcaaacacctctgagtacaatatgtactagctaagtggagaaatggtcaggatcctagaactgatggcttccctgagacgatgatgtgttttgtacgcacccagtcttgccccttgtgatcatgtatgactaaaattcagggtgatgggacatcagaagccacgtcttggtatcaagacttccactgtgcctttaatgtgcaggctgttgttacccatcctgtataatttcttaaagctaactaaatttgttactgggtaaagcctattatgtctcgtaaatttaatcatcagactgaacccaagactgtgccactggctgagcaggctgagttttgtgctagtgaaatgatgtctacttgtgacttccacagtgccatctgctcttgaggagtagctatcagaatggtagacataagtgtcaggaggaagtaaggtaaacatagtcgagaacattttgctaatctaactcattttagttgtagcaaacttccctctatctccttgttactcatgcccatcttcccgaaacttttacttcctcttcactagaatattctcaaacttccttttccctttgctctcagttccagcaaaacaacagctaaatggagattaaaatgttaggtttttacaatactggacagtaaataaatttaacaattaaagtcaattaaataaaagaaaaaactactcaaaaatgttacttatcctttttactctgaagttgcccaacaatacattcattaatagattgtaatttcaacgattcggtttatttgattggctacttaaagattttggcaaataaggagacgcaaaacggggcagcatattgaaagaatctttggaatagattccttgaaagggagaaaagaagatcaatcagcatttacaaggacactagaagaaggagatagtggtgttcaattggcaggattgtctgaagccttacgcttacctgcagtatctcattcgtattctgggtgtcttggtactgtctttattcattgacttaaaaacactcacaagtaagcatcatttactggatcctaggctgagtgtgtatgatatgagtggagaagcagagataaataagagaatgccctctgcactcaaagaacagtgcagatgtgtaatgaaatactcaggtgtataaaatttaagtgtaaatcaacatatgaacaatgggagatgaataaaaaggtttataagaaatcctaacagggattctaactctacttggggtacggaagaaaacttggaagacgcaatgactttgaattcattcttaaagaatggaagaaaattcattatatcaaaataaactgaaagaagtcatttaaagaagagagaaaaccaagatcacaggtatgacatgaaattacatggatggaaaggtaccaggtaatttgatgtggccagactatacggggagattgctggcagaatgagaagatagaaaggtaaagtgtagtcagtctgagagggctttacaatgtctacaaaagagcccagacattatattttaggaacctaatctcataaacaacttcaattttggataaggaatctatgaatatgtattaagcacaattaaaacagggatagaaaatgaatcacagtaacaaatatgatgcaggcattctagtaacataagtttaatgaagaccttatttctagtaaatgctgaggaaaaagcaacatattctagtaaaataataataattattatcattatgacaacaatgatgatgatgacaaagattccctgcttgactaaactttagtcaggcttctgaaccttcgcctgggctcatctttgcactcccctgtaaaatccaggttcagcaaagaagcctgtcagttttacaagaaccctttatccttggtacctgatcaccctcagtattctccaccattccccaagggttgtctgataagataaccctggcctatcttcagcaagaatcctgtgaggttggtttagccagaatcccacttacccctgatgtttcctcttaataattttccatctactgactcctacactgctccttggctataaattcctacttccactgtgctgtatttagagttgagcccaatctctctctatccaacctcctgtaatactccattgcagtggtccctgtgcctattgtggttatcctgaataaagtcttccttaccacactttaacaagtaatattttgtctttaataatgataccaaatgagaaaattcagtgatattgccatttttcttaaaaaagacaaaaatatttaaagcaaaaagttccctaccttaacgtcaaatggtccttcttggtttggttggttataaatttccaactgattcctaataggagataaccacagcagcagatgatttaactgctcttcaaggtcttcaagctttttttcaagctgcccaaggtcttttatttgagcttcaatttctccttgtttctcaggtaaagctctggaaacctgaaaggaaaatacattttaaaaaggtaaataattctcaaggcataagccaaaatgtttaaaaatatattttcaaaagttatttatcatgaaatattacagaatcttactgatttgtgttattttagcagcataatattgattatttacatatattacatgttgggatttaaccaatgtattcaaaattattcattaacctgctacaaaaattctttgctttaaagaaactaatacctttttggaatttcaaaacacacaccttacacaaaggcatagccaactgcaactgataaagtaaagaaatacatctttcatttattcactcagttactaaatatactggtgtgttgtgtattatatgccatacgcgcttcctttgcagttataaaaatgaataagccaagttattcagcattagcaccagatatataacacaggtcttctaaatcccaaatgagtgatttttattcaatgcgcatcctaaaattaaaaccaaaccaactataattttgtttgtatagcaatcatttcttctactatacttgcttctagctttcttttatgtcatggaagattgtaaaaggaagtcccttcatgtacaaggaaaattggtaagttatgcgtttttgtgagctatagtttgtgagtcctagtaaacagaagcaggtggttgagatgagaagtaaaaagaacatttggattagagtagactgtaacagaatgattataggttatttttattaagagatcagtatatgccaaccatcatccttggaagtttcacatttgtagacttccttaatccatccaacaatgctacgacatagatattattatgatcccactatcacacatgggtgatgacgttggggttgaaaaaaacattaaataggttaggaagcagcatgacatggtattaagcattgtgaggtctagagttaggccacttggatttcaattctggttctagttcttgcctaacattttagccaagttttctctaactctcaatgcctcctctgtagattggggacaatgatagcacctgcttcataggattactgttaggactcagtaacgtcatccctgaacataccttagagcaatactctgcatgataatgaatgacaataaagttattaagtagcagtgattattgctcaagcttacatgtaaataaagagccaggataggctgagcactgtagctcttgcctgtaatcccagcactttgggaggctgaggcaggaggattgcttgagcccaggagttcgaggccagcctggacaacatagcaacactcccatctctacaaaaaaaaaacaaaaaaaacaaaaaacaaaacaaaacaaaacaaaaaaacagagccagaataaacaagagtaaagctattttcttcagaatatcaagagttaaaactggcatcccagaataaagaatttaaacttgtaatgatagctctttacgagactattaacaataccactgtaatacaaaatattacactgcaatatgaataaaattttataatatacatctgttccataataatatattatgaataataatagagaagattttaaaaataaactagataatataccagtgtgtcacataaacaatgtcacatgctttggaacaattgttttagatacttttaaaataagtcactaatgaacagtacattgtttaattggatgcaagagttaggagatgaaaaagagaaagttgtcgagaaaaaaatcaattaatgtacagaaaaatgaattttaaacaagattgtatacgtaaacaatatgtacagtgaaacgtcttgtaaatgcatgtatatatgttgtgaaaaattcatgagactgtataagcaaaggattaacatccagcctgggctgttgcaggtcagtctgggactgaccctaggctcccacagcactgtttccttggaaacactaactttaagatgaatgggaaatgttgggcctggctttgtcgtgtggaactgcacctcatcgcaggagctgtcagttggaatacagtccttggatccacgtgactacaatggtgtaaaagactgatgggaaatacaggtggtggctcctgttgaaggtgacctgcacacttcttgcctctcattcctggcagcctttccctgtgtgggtgagagttgggcaaaagaagcattgtgtttcagatagcacagaatgtccatgaatcatgaattgagatattgttctctttgcttgatttgtgttttgtgagttcacatccataactacacctgtggtgctgaactcttgtgtgtgtgtgtgtgtgtgtgtgtgtgcacgcacgcgcgcacacaggtatgtgtgatgtaggtgatgttacaaatatactcctacgtctgtaatacatgatctaatgatgtcctcaacttatttttcaagcattttaaaggaggtaactaaacattttatttttattggatcattttctactcacaagtagatgtaaaaagcgttttacagcttcaactaacaacatctaaatgcctctagactctgaagctactgagataatagccatcatattttcctaaaatctctaaaactgagcgatgaactcctttttatctgatcatgaaattgttcacgtttcatttaggcttcatatataagcacagaaatctgtataacatttaactaagactgctggtttccttatcatcctcccatactatcccttccttgtaatagaggtaaaacaattcctgacagaaaacagtgtaatgggtcagatttgactaatatctggaataatgaaatgatagcttatcatgagacgaaattttcagcttaattatgatgttgctttaggtttatcctctcagatcttgtctttcccaccatcataacatttacctcatgctatttaactttctatttacattgctccttctcactgacctttgatttctgggtcaaacaagctctgttcctaaatatgatggaccttcaccaaaagtttgttaaaaacaatttccaaattcaggattattattttttcaatgtaagaagcagtatatgtctatagtagtcaaccacaaaaaaatgtaaattgtatcctcaagttaaataactttaattaacagacaaaaatatcagtaaactggactatataaaaaatcaaaagcttctgcacgaccaaaagagccataggcaaaatcaaaaacaaatgaacaattatgaaaaataaatgcttgtgactcatgtctaagggactaattttcctaacacatgaaagaccttctgcaaagtaataagaaaaaggccaacaacccaaaagaaaattggacaaaagataaggacagttcacagaaaagaaaatacaaaggattttaaaagcatgaacagaagcttagccttggtaataatgagagaaatgaaaattagagcttcatctattgcactggcaaaaattcaagtctgcaggtacactatgctgccaaggctgtgggaaaatgcagactcttctacgtggctggtgggaagtatacatttgtgtacctcttgtggaaggcagtttggccatatctataaaaagcatgtaaactttgacctggaaattttattcccaggaatttattttgtagatttgtttctagaattaaggttaatgtgcagtgagggtagagcagatgatgggtagggtgagatattttttactgtaccttttatattttgaacaatgtaaatgcattactgtattagtctgctctcacactgttaacaaagacatatctgagactgggtgatttataaaggaaagaggtttaatggactcaccattctacatggcgggggggggcctcacaatcatggcagaaggcaaaggagaagcaaaaacacattctacatggcagcagggaagagagcttgctcaggggaactcacatttataaaactatcagatcttgtgaaacttactgattatcaggagaacagtatgggggatcctcttccatgattcaattatctgcacctggctccacccttgacatgtggggattaccataattcaaggtgagatttgggtggggacacagccaaaccatgtcaattacttttgtaaaaaattatttaataaggaaaactactgtaccagctcatcttcctaccacaaaatgttgttgagaaattacactttgcatattttaataatgaatcattattattctggtataacatatctaaagccatcagtgaaaaatgctctgaagagttttctttggcaatatcacttaatggttgggtggaaatcaagaacttttaacacatattttttttgtgctcttctgcactttaaaacagtttccaggaatcgagagtattccaaatacttcacggaaaaatataacaggtgtgagtaatgtataacgtggaaaaagattaaggtttgtatcagattctatgtgttttaaattaatttacatttatatttactattttgcattcacatcaaagtatagacacaaacacctgaccggtaaaatacatcatttttctaataatccttttatgtattataaaaccatgctcttcatataacatgttccctgtggtgaaagaaaacaaacacattcaattcccttatgtgttaatttagtatctaagcacatcttgacctaatttcacacaagattactttccttattctttcaatctctgaatgttaatttcaaatgtatatgttttaatattaagataagcaaaagtgtctgttttagaaataaacatattaagatggatttcataacacaaaacattttagaaaaattaaagtgttaagcataaaaatagtaagaagaactggaataaaatattggcgtggggaagccttttagaagcaaaaaaagaatataaaaagattgaatataatatgcgtattcacttataaattaaagccactaatcaaaattaaaacaaatgacaactgggaatatttgcagcatatatcagacacagggtaataattttagcatataaaaaaatcttttaatgagtaaaaaaaggaaaaatctactggaaaactggataaagaacataaaaagaaattgacaaaaatgtaaacagccaataaacaagaaaaaatccagacagttagtaatcaatgaaatgcaaaggaaaacagcaatgttatactattatttatctattatattagtttctgtaaaaggtctttgtcaaagttctggaaaacaagcaattttatgatcttccttggagccctattatacagtcattcaccacatttcagtcaacagactgactgtgatcctatgagattacaatggagctgaaaaattcctattacctagtgatgtcacagtgcaatgaattactctcacgtttgtggtgatgctggtgtaagcaaacctactgcactgccagttatataaaaatacagcacagacaagtatgtacagtatgcaatacttgataatgataataaacaactgttattggtttatgtatttactatattcttaattagttcaaaagaaggcattgttatcctatgagatgatagtttcatgaatgtttcattgcccatgaagaccttccagtgggggacagcatgtggaagtggaagacagtgatattgatgatcctgacccatgtaggcctaggctcatgtgcgtgtttgtgttttactttttaacagaaaagcttaaacagcaaaaatattaaaaataagaaagctgctacaataaggatataaaatatttttgtacgggtgttcaacgtgttcatgttttaagctaagtgttattacagagtcaaaaacttaaaaaaaaagtttataaagtaaaaaagttactataagctaaggttaacttatcattaatgaaaataaatgggccaggcgcggtggctcacgcctgtaatcccagcactttgggaggccgaggcgggtggatcacaaggtcaggagatcgggaccatcctggctaacacggtgaaaccccatctctactaaaaatacaaaaaaaaaaaaaaaagataaaaatgtgtcctcataaatttagtgcagcctaactatacagtgtttgtaaactgtatggtaccgtacaataatgtcttagatttcacatttgctcaccactaccactcactcaccgactcacccagagcaactttgagtcctgcaagctccattcatggtaaataccgtatgcagctgtactattttttatcatttgtatactgtatttttacggtacattttctgtgtctagatacacaaatattgttgtgtgacaattgactacagtattcagtaaagtcacatgcagtacaggtttgtagcctaggagcaatatgctgtaccatatagcctggatgtgcagtaggctataccatctatctttgtgtaagtacactctatgattatacaacaacaaaatcacctaatgacacatttttcagaacatatctcatttgttaagaaatgcatgactatatatgttgctagtaatttggtaattcagaccgaaaagttaagcttctaccctggaaactacaaacactactgagacagtgaagaaaatgtaaacaaatagaggactaccttcttcatgaattagaaagtccaatactgtaaagatatctgccctctcttcaaataatctataaattcaatgcaatctcaatcaaaattgcagcaaccatttcttagtagaaattgacatgccaatcctaagatttatatgtaagtgcaaagggctaagaatatccaaggcaactttgaagaacgacgaagtttaagaatgtttgccaccagacatgaatatttattataattaagcctgtgtgggattgaagtgagaacaaatcatctatatagcgtttcctaatttatacgatggtgtcacttaagttggaaaaggatgatcttttcagtaaatagcaccaagttaactgattagtcatttgaaaaacatgaaccttgactctccacatcatacacaaaacataaattctagattgtttgcagacctcaatgtaaaaggcaaaaaaataaagttttcaaaagaaaatatagaaaaaaatctcaacaattttaggttaatgtattattttttaaacaagacataaaaagcattagccataaaggaaaagactgataaatcaaactccatttatcaggaaagattgttaagagaaaaaaataaagcaaagtttaggttggaaaaagatattcgcaatgcatagatctgacaaaggacttgtatccaaataacttctacatcagtaagaaaaagacaactattatttttaatgggcaaaagatttgcataatgacttcacataagaggatataaaaatggcactaatcgtcaggtgattgcaaattaaaacacaatgaaataccatttcacattcacctaaatggttaaaaggataaaggttgaaaatacatactcttgatgaatatgtggatcaactagaagtcttatatactgctggtgaaaatgaactgaaatgaccacactgaaaaactgttttttggtgattccaaagccaaatgtacacatcttatgacctagccattgtacttccacgtatattaaaaataaatatatacatatatgcagcaaaggacaggaacatcacaccagcatttttcctaatagccccataatagacacagcccaatgtccattgattagcagaatggataaactgtggcatattcacacaatagaataccatacatagaaaaactaaactaactatggcacaggcaatagcatagaataatatcacaaaaataatgttgagcaggacatgtcaaatacaagggcatatactggatgattctgtttatagtaatttcaaagtcaaaactaatctaggtgttagaagtcaaaagagtgcttatctttgggagagggtggtggcaggggagaggctcataactgggagggaacatgagaggggctcctgaggtaatgttctaattcttgaacttggtggtagtagcatggatacactaagttttttttaaaaatccctgaatttctattcttatgatttgtgtacttttctatgtgtctttatacttcagtttagaaaatttgataaaactactttaaaagccttaagattactcattcccttcaactccaaaatgctacttctatgaattttcctaggggaatatcagagataaacacagagacctatgacaagaatgttcaattatgtcactctggcgaaaaagtgaaacgaaatctccccaaatagaataaactgcttttacataatgaaatatgttgcgtccattaaagtaaatattatgaaaaacatcctattacactgaaaaatattaatgacatattaaaaatatattaaaaataaattatggttttgattttgtatgcatattttacatatcagtatcgacacacagcaaaggacatgaatagatatttctctaaagcaaacatacaaatggctaacaagcatatgaaaaaaaaaaatgatcaacctcactaatcagcagggaaatgcaaatcaaagccaaaataagatatcatcttatacctgttagaatgactattatcaaaaagacaaaagaaaagtgttggccagaatgtggagaaaagagaacccttgtacaatgttgatgggaatgtaaattagtataattattgtggaaaacagtatggaagatccacaaaacattaaaaatagaactaccatatgatttagcaatcttatctctgggcatatatccaaaagaactgaaatcagtattttgaagagatatctgccctctcatgtttactgcggcactatttgcaatagccaagatatggaatcaacctaaatgtccatcaataaatgaacggttaaagaaattgcggtatataaacacaatggaactctattcagccttaggaaagaaagaaatcctgtcatttgcaacaacacggattgaactggaagacatgatgtcaagtgaaataagctaggcaaagaaaggcaaatactgtatgatttcacttatatgtgaaatctaaaaatgtcaaactcagagaaacagagaaaaatggtggttattagatcctgggggtggggtgatttgggagatattgatgaaaagatacacaatttcagtttgacaggaggaataaatcctagttatctgttgtaactcagggtgactactgttagtaacaataacgtatacttggaaattactaaaagtagattttaagtgttcttaccacaaaaaataataagtatgtaaggtaatgaatatgttctatagcttgatttagtcattccgcaatgtttatttcacaatatgtgatatttcacaatatcacattgtacaccatgacaataatacaatttttatttgtcaattttttagaaaatttaaaaatttacacatagattttcatatttgtgaatgattagaaatacatgcacactttagtaaccttgaaaggagtattataaattatacatgattttaatgtaatttttaatatttttgtcccttttcaaagttaccactcagaaagaatattatatgttttatatgttaaatagaaataaataataagtagtactggtttggtggctattcctctgaaatattagcaacaataaaattactattataacttaggtttacaacatatttcaggtacttcatgatggattttacttatattcactttcttattctacccatgatcctatgaagtacataacattttctaaaattatcaagtgaggatattaaggatcaacaatataaataatattcataaggttactagtaagtaacaaagatggcactaaatatccaggttttactgacttcatattctactctttccttccctcttccctcccaaaacatactttccagtatctttcaaaattgacatcatctgggccgggcgcggtggctcacgcctgtaatcccagcactttggggaggccgaggcgggcggatcataaggtcaggagatcgagaccatcctggctaacacggtgaaaccccgtctctactaaaaatacaaaaaattagccgggcatggtggtgggcacctgtagtcccagctactctggaggctgaggcaggagaatggtgtgaacttaggaggtggagtttgcagtgagccgagatcgcgccactgcactcctgcctgggcgacagagcgagactccgtctcacaaaaaaaaaaaaaaaaaaaaaaaaaagaaaaaaaaagacatcatttgataaatggatctatttaaacttatgcttttcaatagttatttgtgtgagtacaatctatacccttaatacttagtatcattaaagcaatatacattgagaagtcaacttcaataagaaataatataaatgaaatgcatgcaagtaaacatattttgaaaatgaatattaatatgaatattttgaaaattaaaacattactgtttgccatttgttaattttatggggactagaagaacagttagaatgcttatcaaatgcatttttggattatgattaatccaaaatcatgtttaaattatcatgatataattgtgataagcatcttctctattttggttggcttgtcatttattttataatagaagcatagataacataagttgttataaagattaaaaataataatagggaattttcaattccaataagtaataatttacatgatattttagcattattttcaaaaaatttaatgtaaatgctgaattcggaaacttctgtacttaaaaaataaagacttgattgaattttaacttaattttaaaatcctatctcacacaattcctaactaaataccagatgaatgaaatgttacatgtaaaaaaattgaactataaaagtaatgaaaatatgggaggctattcttataattttaatttaaaagccataaagtaatgacttacattcatagcagtataaaatttctttacataaaaaatcaaacaagccaaagaaaaaggcaaaaacaattcatctttttgacactcttaagataaaaacattctcacaaatcagtagaaaaaaagacaaatactcaattaaaaaggataatgaggaatagaccatttaggaaagaactataactgacctatgtataggcctattaaaattgtttgacttcactaggaaaattcaaacagggaggtgtaatattgcacctattgatttaacaaagatttaaaacactatcttgcactgcaatacaatagtctcatacaacagaaattgtgtggtgaattgggtcttctcattactgatagcaagcaaataaaatgaaatatctctgggagtggggttgggtgtcgatgaggtaggtttttgtagttcatatctaaagtctaaaacattttagtgcacttagaccagagattttacttttaaaatttcaaaaaaattttctgcaatgaatatgtgcttcttttaaaaaagaaaatcattattttaaatataggtacacatgtatacttctatagaaagaggtttatgtatgtagtgcctaaaatgtgcccaacatatctatcaacaacatctaataacaactctataatacaggtagtattattgttcccagtgtacgcatgtgacttgtacaaggtcagatagctgtgaaatggtaaccaagctaggatttgaacccaagaagttaggctttgaagcctatcctgttaaccactgtactattttacctctcattccctttagctatatgactttgagaaaatatactatatgagtgcaaaagaaggtttgctttttgtttacacaatttcacaaaataaattcctttaggtactgactggagcttactacaatttcttcataactttgaaagtaagtgggatgatagagccctattttccttgccactatcaaattcagttttcaaaactgccactcattgattctcttgcttaaaattgtgtgactgatttccaatagcctccaacttctttagcctgcctttatctaaaaaatggttcttaacaatctgacgctatcttccattcttcaaatcttcctaataacaaagcacttcttttggtctgttcctctgacattgtgtactctgccattaaaatgtcttcttttccctcaataaaatatctcttttccttatcgacacatataaaactcttcccaatccttcatgttttgggtaataaaagttccacctcctcagagaagattgcttaatccctctggaaggaaataatgattctatctaataaactctagcattaattacctgggctacttcattagacaccgtcagttattacttttttctttattttactgttctcttccaacttatgtcttctttcttctcttgtctctccccaaaagctagaatactcacacatacacacagccacaattgaattttacatctttatataccgttagtaacttttcttacatgatatagcatttgttaaatgaacaatcatacaaaacaatcaatcattcgctaataaaacagaaaagagaaggtaaatctcctaaaaacgcttatgttcttgtacactttgaaaacgcttatgtccttatacatgacatttccaactctgtttcccattttaggctatgtgtgaatatccaagttcactagcacagtcagaacaggtgttacttggcggctggactagtgaaatttgatgtgaggaatacagagtagaagagggtagaccctcttgagggtcagtcaagaggactaaggaataaaattcttgatatgttttctgttagttagcttgatgtcatggattctggggctggagacagggctaggtattaattaattgcaggactagtggtaatatccgtgtaattaattcaatcaatatttacctagtagctattttgttccagccgctgccctgtattgcttctgtagttgactgaagttggccattgtatggctacgtgtaagtctccaatgccaatatccctctaccttgaaaatagctaaataacagcgcactctgaatgcattttaggcaaatattctgttgcccccaaccaaaaatcacctcccccaaattagtaataccaattaaataattcatgtaaaccattatcttcttttggataaaatgcacgtagtatgaaatatttggagagttcattttgcctcacacatttcttaacaacaataaattaatgtcactggagaactagacttagcaaagatatcttcccaggcacaaaactcgattatttttacaactggtctcgtggtaaaatatccctcactaggaggtcatttattttctttccctctggaaatttaataaaataatgatgaatatatgactgaaaaatacattgtggttatatgccaccagatattttaaaactataaatccatatacaatgtaaaagtgactaattacaaatcatttttatgacattcagcccccagtggcatagctctcggaatattactttaaaagtaagtggatttcctttttaaagcatgtggattttacttacgatgcttatacatctatatttcctacattgtttccagttttaagtatctgataacagtgaagtcccctgtgtcaaatcacagtgtatgttagttttattgcataaccacttcattaccacacatggattttgttatttttctcaagacctcaaacatataatacattacgaggtaaatgaacatttctagcaagatttcaaagtcagtaaaatttgatgtacaataaataggttggcagtccttggagaactctgcccttattaccacactaaaaccatattgacttttcagtaaactttggtgttcatgagcagcactgttattcattaatttatttgtttgcagtataagcatctaactccatggtcaaagaatacttaataatatacgtgagtacatggataatattttctgactgttcaccttgatctaaacctaccctaaagttaggtaacaagccctttaatggctcctggaggcattagacaaatgaagtgaataggtgacattgatttgctcaaacctcaatagttctaaaatggattttatagggatttatacccatctaactatccacctacccacaaactcttcactaaataatgtgattttggtcacatactgtttaaaccctgaggacaataaaatttaaagaagttaaatgtaatttaatctctctctctgtctctctctctctctctctctctctctcacacacacacacacacacacacacacacacacacgcacaccacagaatgtgttgttacaaattaaccccgtatttttctccctctctccctccctcccagccgtactctaaacaaaggctctacaaagtagcactaaacaagggctactttattcccacactctccaatcagaaatctttgatcttatttgcttgaaggaccttagcatcagcctggctgatacagaaaaatgtcccttggattcgtaggaaatatcatttttaatatttttgtttgctcattttgttcatttgtttgataaaaattcaaggaaaactaagtcatgatctgtacagttttacccaagcaacaagaaccataacaaataacaataacttgatatttatttaggccctgaggtgtctgttaaaatttggtttcttaatagaatttaaaaaaaaaaaacagtctccttctttttacttttatataaatcactgtacttcagaatatggatttcagggggggaaagaaagggaaaactacaccacataatcacgtatcctcaaattcagaagtttcatttaagaaacaatttagctggggatggtggtgcctgcctataatcctagcactttgggaggccgaggaaggaggactgcttgagcccaggagttggataccagcctgggaggcaacatagtgagattgttgtttcaaaaaaaacaaaacaaaaaaaaaaagaagaagaaagaaagaaagaaaaaagaaaaacaaagcaatttatcaaaatgtaactttaaatttaaatgtattaaacttaaatacaatttaaatatcagttccttagttgcacttaccacatttccaatgctcaaaacccacattgtattagacagggcagagaaagaccatactcattataaaaaagttatcttgaacagtgttacaagccgtactacactatttgcttatgcatctaaaaaacttgccaatcttcatgattttttgaaagcgtaacattttagaaaataatcagtagtgttcaaatatatataccaatttgatagtttcaataatatgaccatgaattgctggttttaatttcaatattttctgtctagaaagcttgtttttctccaaaactcattctctaaaaaacaaaacaaaacaaaacaaaaatagaaaaccaccacactgaaaagaaatcctattcctttgccttcatctgaatggaatcattttattgtcatgtttaaacatataaatataaaaaaaattttctatcaaatggcatgacctacataactcacatttatcttttctatgtgtaatattcatattgttgcaatttgatgcattattgttatttatactatgaagcaaatgcatattgcttatccactcaatgaaacatggctaacaaagaagaaaatcagtatccctggaacttttaaccttaccaacaagtaaaataataatatcatatagaattgctactcctgggaatggtgatgcttagaaaggttttgaacacaacatcgggaagagttggcattggcatatgtgaagttgtagctttactagctgtgtgacggtatgaggaaagtgaatacaattcaaagatgggttggtctcttcctgctggccagaagagaagagagcaaagaaaaaaagagaatatggatataaatttgaaaaagaaaaatacttgatttctctggaaacaataaaaaaatcagggcaaaagtcaggtgccaaaatagttttatattctgcgaggattgttgccataaccccatttcaacaggagacttgggcagagggcagcaaactatggcttatgggtcacattcagccaccatatgtctttgtacagtttgagaactaacaattgttttaacatttgaagaaactgaaaataattaataaatgggtgagacatgaatattatatgaaattcaaatttgtgtccccaagtaaattgtcacgggacacagccatgcccattcgtttatgtgtagttacgtattagggctgcttttgatccacaatagcggtgttaagtagtcgtggcagagacctattggcctgcaaagcctaaaacatttaccatctggaccgttatagaaagtttgctgacctctgctctaggtgttcaaggagttgtggcccaacctccagtccatctaagtcttggtcctgcctgtatttcagagccgctttaacgggtgagttggtgagtgcagtacagggcttcaatgtacgagaaataaaaaaacttttaaatgcagtatccattaatttacccaaattggaaaatggacaagacagcatcctttggtggaaatttttttaaatccacgaccctcctggtctgtttttgggacactttgtagccagtatgtacaaatgtctgatttagctgggccatccatctgggaccagctagctgaagcttgcaatcgcagttagctgaaatttgaaacttgaatatttcaagtggtagacatttagcaataacaaattatctacatcattatttgatatcttttaatttgcattccaagaagttgtgcgtttccaaagcagtgaaagaaaataaaacaaaaatttaaaaaatggaaacgatatgtcaacataaaagccagaaaaaaattaatttttaaaatactattataccctgtaaattacgtgtagccttgatgggcatagaacttcaccggttaatatggtagccactaaccacatgtagctattgagcacccagcccagaatatgcctatttggaatagacatatgctgtaaaatacatattggattccgaaggcatagtactgaaaaaaaaaaagaatccaaaatattttaattcatccatgcatcacttaatgacaggaatacattctgagagatgtgtcattaggtgattttatccttatgcaaacatcatagtgtgtacctacacaaacctaggtggtacatatagcctactacacacctaggctacatgatatagcctaatgctcctgggctgcaaatttgtgcagcacgtgactgtactgaatactacaggaaattctaacatagtggcaagtactcgtgcatctaaacatacctaaacatagaaaaaggtatggtaaacctactgtattataatcctattagatcaccagtgtatatatagtttatcatggaccaaaacctcattacacatagcatgactgtatttttgcactgattgcaacgtcaaaatgatacaattttagatacactgggttaaataaaacatataatccaaataaatttcacctgtttatttttactattttaatgtggccattaagattaaaataacatatgtggctcacattacgctctgtaataatgcaatagcagcttttattctatagtaggaatagcagaaaaatattaaatgaaagatcatccatagatgtcaaaagtcatgtgagttttagtatatcttctaagttgattattttaataaaaggtaagaggtaaagaggttttcttattaacataacatcaatttttcttgcccccactaaataaatgctgaacaaatattttaagcaagcgtatgaaggagcatcaaatagtagcttgtcttgaacaaggtgtccccagtgtgtttcctagactcattgaaaagaagcaaccttacgtatgttaatcccatgtggttaatttctggcctccatgtttaattgatctctcatactagggcctctagccaccgtcctccaaggttgtgcatgaaaccagaaccctacagttttgtctgaagcacactgcttgtcctacatttttggcccccaggctgcatatcacgcaaccctatttttcattaacttctggtctgagggggaaggtactgaaaaaaggaagagctgtacttgaataatgttactgtcacacaaaaaaaggggaaagggagggagggagggaaaagacctggcctccattcccgggtctcagatgaggatgcctggtggtagtttcccttgtaggagggataggcagggtaatcaagggaaggaaagagagagaggcatgtggcgaaaaagggaagtgagagttgagggattacactagtgctgcatgcaggggaagggacagtaactaacagaggtttggaagtcaggcaacctgacttctaataccacctctaccgctacttatagaatccgagggccttccctgagtatccttggaactgaaaaatgcagacatttgatcagattaattctgaggtcccttctagcttgactgttccacaaacattttgtctctggcagggaatggaggagtatacacagccctgaacgtgtcactgagcttcaagaagacaaagactgtgtctgcctgacacctggatgcctgtgaacacaaaagatcttctctgagggtttattgggagcttgtgacataggcctaaaatgtggaaaatcctgtgacaacaggataccctgtcaccctaagcagatgtaagcttaattttcttcacagcaagataatgagcaatagaatagaacctaacaaagcaattttggatgagggcttaacacaatcaactgccatggtgttccagccatttatttacaggatttaaacgtctttcctccaaagccgggactcctgccagataacctgtgtaatggacctagtgcaatgacctacaccaaatggctaacaattttgtccagcccatgggctttgcgagtggggctcatctcttggctctggctaagtatgcagctacattcccgatgatgtggcaacattttaggctctggtttccaggagagagctgagacacagctattctcaggccttgggaaccaccgctttgagaaacaagttaggaaaatgcagaggaccttacgtcccgggggaaactcacagaagttttggggcatctttataatatttgtcaatgaaagggaaaggaacattcctttgaaaggcaaacacagaacttgctctgttcccaacttatgcctccaaggctgtgtgaggagattcttctgaagtctacacatcgctgtccattagagcatctctattagacagacattttaatttcttcattgggatgaaactttttacacagtagatactgcgactttgtaatgtttgtatgaactgaagctggaattaaaacaacaaatctgaagccatggtctttttcatcacttttatataaattactcagagttccagattgcaattcatctatatatttttacaggtgaagcatgaatttaaaaaaaaatttaaaaagtggtttcactcatttaaaaaactgttgaattggttagttggttactggttaaaagaaaaattatttagggccttttatatgccaggcagtatgctaggtaaatcatccctcccttctatgaacacttattctggaagaaaaaaaatgtatttaaacacagaattcaattaccaagtgatgaatactctaataaagacagacacaatacactacaaagtcatggagtctggagggcctctgtctcctggagaaagaatggagagacaggaggcaggagagaaggatgatttcacagaggatatctcatttgaattttctgttaattaatgggtaaactatcgaaagctattctgcgcagcccattaaaaggtactctgttggctcaagcttgacagtgtgtgaggaagaagaaagagatcttatgactagggttgccttataaaatacaggataccatttacattttgtataagcaatcgatacttttcagtattttttgttgtagtatttgggacatagttatgcttagaattctggatgtttcatatttttatttgctaattcttgggatcctagttatgactggaatgtggaagaaaacaataccagctgaatatgatttgaagagttttgtgtgccatgacatggagttttgaacttattctacagggataaacacttttgaaaagagtttatacaaagttgactttagaaggattagagtcaaagggggacttgaaaccattaagaagtcaagccccagtaatggcatgaacagagctcattctgctttccaaatatctaatctgcagtagatacttagtggctggaatcacctctgacatggctgacctgtgacagctatttcatctgcacattgccaatatctctgtgcttaggagattctctaaagcgcggcataatttttcttggatttcccctttcctgtttcattaaccctattctttcactcttacatttgaggatgaacttctctgcttccaatttcttgtcttacattctgttcttgagtgtatttaaactaacactttatccttttccatttcttccaaaaagtaaggataaatggtccttgatttatttgcaagctacttctttccctgaaaaagtttgggtgatccttagcatcagggtttagtatgactaaaagaaaaatatgtattagttattgtacaagataacttgaatgatcttttaaattttacagttcatatgtgaaagaaacttggcagggtcttcctaaattggacaataaattgtaataatttatgtgacatcaccaataataagttgaaaatgtaaaataaacttttctaaactatcaatgatagaagtcaaattttaatcaacaatgctgggggaaagagtaaattattttctgatgctctcacatgaagaggtgctgaaagaggatgcatccagaaagatagaaaaaattatttcagacactgtatattctagtattgcagagatggttcattattaagaaaacattctgcttatttttttcaatttttgtgatgtatgtggttatctgtcatctttttaaaaacgtataatttgttatgatttcctttctttctataatcatgttcatacctaattttatatttgtcctgttatattctttgacttaaagaaaactgccaaattagaatgtgcttcaagtttcagaaaaccagatctacctctgcttattcttttacctttattgagtatagaaaaccatttcattcagtatcctaaaataactaatttggtataggcattgcaaatctcttcttttactttgaagaccccatcgtttctaacagatgtaaaaacaaaaagaaaacaaaaataaaaaatgattttatctgacttataagtagtacattaaaactagttgagtttttgatctaaaatttaaaaataattagccgagtttctgatagaacaacattttacaatttctttgcttttttcttttttttttcttttattattgtactttaagttttagggtacatgtgcacattgtgcaggttagttacatatgtatacatgtgccatgctggcgcgctgcacccactaacttgtcatctagcattgggtatatctcccaatgctatccctccccccttcccccaccccacaacagtccccagagtgtgatgttccccttcctgtgtccatgtgttctcattgttcaattcccacctatgagtgagaacatgcggtgtttggttttttgttcttgcgacagtttactgagaacgatgatttccaatttcacccatgtgcctacaaaggacatgaactcatccttttttatggctgcatagtattgcatggtgtatatgtgccacattttcttaatccagtctatcattgttggacatttgggttggttccaagtctttgctattgtgaatagcgccgcaataaacatacgtgtgcatgtgtctttatagcagcatgatttatagtcctttgggtatatacccagtaatgggatggctgggtcaaatggtatttctagttctagatccctgaggaatcgccacaccgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgttggagttcattgtagattctggatattagccctttatcagatgagtaggttgcgaaaattttctcccattttgtaggttgcctgttcactctgatggtagtttcttttgctgtgcagaagctccttagtttaattagatcccatttgtcaattttggcttttgttgccattggttttggtgttttagacatgaagtccttgcccatgcctatgtcctgaatggtaatgcctcaagagaataaaatgcctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggtcatactgcccaaggtaatttacagattcaatgccatccccatcaagctaccaatgcctttcttcacagaattggaaaaaactactttaaagttcatatggaaccaaaaaagagcccgcatcgccaagtcaatcctgagccaaaagaacaaagctggaggcatcacactacctgacttcaaactatactacaaggctacagtaaccaaaacagcatggtactggtaccaaaacagagatatagatcaatggaacagaacagagccctcagaagtaacgccgcatatctacaactatctgatctttgacaaacctgagaaaaacaagcaatggggaaaggattccctatttaataaacggtgctgggaaaattggctagccatacgtagaaagctgaaactggatcccttccttacaccttatacaaaaatcaattcaagatggattaaagacttaaacgttagacctaaaaccataaaaaccctagaagataacctaggcattacaatttcttttcttaaggaatgatggtttgagtaatcctttagggttttaccctttacatgccattaaattgtcataattaatcatcatgcaacaggttgtaacatgtaaagtgacaatttagaggctgatacagaagaatagcgaataacaggggtttagtttttatgcatcatttcttcaggaaaacacatcatgaggggaaatagctttgaataagttcagtgaaggttgccatttagttaattaacttaaccattttcattagcagactcagtattgactttagaatactgtctgcttaatttcttccaaacaatgaatatgtatgaaacaccaccaaaggtaaagtgaaaatgaagacaatataggtaaaatgtaaaaattaaattattaaaatatatcagaaaagtatgtggaatacatttataaacttatattcaattgcagtgtgctcctccaaacttttaagatatgaccttggcataggcacattatttcagctgcttagcacaggatttgtaataatctcaattttataagaaaatgcatttctaaattggttggagaaggctaaaacaatgcataaatccagtgcactgaatataattttctgcttcaactgacgatctagtcttttgaagaacaggcttttttttttttaaccatttttggccatattcattttctgcaacttcatgttggaataaataaaatcagcaggtgcctattgatttttggagggagaaatctcattcgtaagactgaaaaaaagtgaagtccatcataaccaactgatgaacaaatacgtgtgaaaattgaagaaaataataacgtagaaacaaagggtaaatatcgatacaactatttaatatgactgattttcaaatctggatttgttgtctctaggagttggaaggtgggaaggcctgcaaaattttttttattaatttaaaataggacgatatacattccatacagcgattatttattttcttaaccataacagtcttaactagagcacacagcagaatcaattgggtaggagtttttgttttattttgttttaatatgtatatccaagctccataccagagaatctaattccataagtttgtaatggagtcgcgatagctcaacctaatttttctatttataatatagaaatagatgcttagatcccagtggtacaaacatccctgctagagcccacacaaactgcaatgcctattagtagtaagaaaatgagactgcttctctttttaacattttgttctcattctcaatctgcatttacctcagatttactaagtctaaaactcaagtcaagtgtagtgcagtaaaacaagtaagttaagagctggaaggactcggtgtaacagtgtgcattatgacttatgtgcctttggattttagttttggggggaaccactttaagcccatttcttcttttgtagaacagagagttaattctcacagtatctatacttcctagttcctcttccttttctccatgtgtaatttactccacagtcttcttttattttgcatcactgatacggtttggctgtgtctccacccaaatctcatgttgaattcccatgtgttatgggagggacccagtgggaggtaatttaatcatgggggcaggtctttcctgtgctgttctagtgattgtgaataagtctcatgagatctgatggttttgaaaagcggagtttccctccaaaagctctctctttgactgctgcccatccacgtaagatgtgactcgttcctccttgcctggtgccatagttgtgaggtctccccagccaagtggaaccgtaagtccattaaacctctttcttttgtaaattgcccagtctcgggtatgtctttatccgcagtgtgaaaatggactaatacagtaatttggtaccagtagagtggggcactgctgaaaagacacccgaaaatgtggaagcgactttggaagtgcgtaacatgcagagtctggtacagtttggagggctcagaagaaaggaaaatgtgggacagtttggaacttcctaacctcttacatccagcctggccttttacattcccagagcaagaagtctgttcaagtccttattatctgggccaccggaaaaaatatatatctcaaaccagtttgtagacctccagtctctacctgctgtaattcaacccctgcattgccatcagactgagtcttctaaaataaaacttaattcttaaaaatgagtccctcccctgtgagtggattatcagtatttgttgtatgtgcatatggggaaaggttacgctacccatgctcctctagacattctggtatattctcccatgtagacatacaaggcagagccaaggccttcctttatgaaccatttactgggggaaaataatgtatcggatcactttactccctgatatggactaatgctagaagcagttgaatctactgtctttaatgggacagagttgtgctcaaggatcattaaccacaaccaccgcccttactcagagataaagatttaagatctcttagcatggtggctaaaggttttcaaactcttgcccaaacataccttttcaatgtcaaacacaatcaccttgctctattcaggaggaatcctaccataatattttgtttacagtctctccacctataataatctttcctcttctcttgagtactgcaaattctacttcagaatagaacaatgtctacatgagggccttcttttgtggtccaaggccattttgcttctgctatagtttatttgagaaaataattgtctgtccttgggcaactcctgtactaccgtcctttgttgcaatctcaactttccacataattactttccaagctatactacgaggcaaagggaggattatgaagggtttagggttactctctcttccgcttcactgtaatttctattctttatttagaaacattctgtctattcctttattattttgtagtctataataatcatacaacatcttattaatatgacactatattttggatatgccctctattatattactaatatttacataaatgtaaacatttttatttccatgatcctagtgacttttaccgtttctaatgtatttatttttaaattaacacataacattgtatgtatttattgtgtacaacatgttttgaaatatgcatacactgtggaatggctaaattgagataattaacatatgcattaccccacattcttatcatttttttatggtgagaatgtttaaaatgtaatctcttggcaattttcaagaatacaatgcattgttattaactatagtaatctccattccttttaggtatctgcttaggctggtatcatacacataataaatgttcaattatttatggaatgaacaaacccaatgttttatttctttaatgaattagttcattctgaaaactaatacttctgtcaatcaacaacaatcaatcaaccaacttcaaagtaacttctcttcgttagagatgactagcagccttagtatcaaattggtgattattaagacggacaacatgataaaatattcaccccataactcccgctctccaaagtgaattctttaaatctcttttgatatgcaaagttcagtgagaagtgaacaccttctgtcacctagcaacgtgctgatcttaaacaaggccagttaacctcgctgaacctggatttctctttctgaacaaagaaagacaagatccacctcctataacttctgtgactcaaatgagctaatgtataggaaatactgtgcaacatatagtggtttataaaccataaaattctgaaaaaattagctgattgaaccagtgagtagagcgtaggcaaagcgatataagagcagtactaatttgctgattaggtgatgaaaattagtaaacactcagattttgctactaataaatgtattgctgcaaaatgtaactgacggttaaactacaatcattcaataataatttgttgaacatctcctaggtataaagcattataagaccaaaagaaatccaagaattacatcccgtataatcctagttgtggatttatatttttctttttgatactgggtgtgtaaaatagactcaaaaaatgattttttcccctttaagatttttgtttgctcattgaatcgtggttggctacatcaggcagagattttaagggaaaacctattttcaacaagacagagtaagtcaattctaagcaactctgcggctaatacatgttgtagggttcatataatttcttcttcacagagacaattgtccctattatgacacctctcaacattgccattgtttatctagaacaatgacatccaataaaattataatgagagcgatacatgtaatttaaaattttctacacattacaaaagtaaaaaacaggtcaaattaattttaatgttatattttctttaacttaaatagccaaattgttgtcacttcaacctgtactcaatataaaaagtaccaatgagatattttatttttttcatacttaggttttgtaatttggtgagtgttttatacttacagcacatttcagtggggactagccatatttcaaatgctcatatggtaggctgttgttaccacattggagagcactgatctcaaaggaaagttggacatttcgtccaagtttttgttcaaataaaaaactgattaaactttgagcaaatatgaattattcttatcagtctcttattgtttcttcctctcaaaaatattcgcaatattataaaaccagcaatgttaaacatactgaactcaccatttgaaaaagatggaagataagaatcattttcacaataaatgctgtaccatactatccccacaccaaagcagccattttgttattttaagaaatacatatgaaaattcttctgtgaatactgaaagcaaatgtgggtataaatctctgcttatgcaataaaatgtatacttaaaattacattacagatgaagaatcatacatagctctacctttgctgtattttgacatttctgtttgcaataaaagctttttaatagaggcacagctcttcatgaatatagtaaggattttagttactaggaaataagaaagaacattacttcaatattgagttcttaacataaatgagagcataaaaattacgtcaaagatatctttagattttactaggaaatatttgccacaatacttttgaaaaaataataggaattttatagacattcattatataaaaaataaaacaccatatatgaaaatatgagagtttaaatcagcatgagaagctttgcattaaaactaaatacatatgaatcatctgtatttgggagcctcagtggttgcagccttatactatctcttagagaaaaatatttcataatccattccaatcatgtatgtattaaagtttatgacaacatagctgtcccccaaccccatgtactttttgaaatatgaaggaataaattcaatttcttaatatattactacacttaacagattatgacaaatacttctctaattatacaaaaaaattaggtttggagaatcccagagtattagctgcattttcaaatgccagcaggtgaagggaaataatccgtggtgggaagactctaaaatggcactcagtgatctctgtctcctagtatttgagtcctttaataatttcctccccttgagagtggtcaagacttttgacttgcttctgacaagcagaatatgtcaaagacaaaaggatatcacttctccaattaggctacataagattgggacttttgtcttgctagcaatttcactctttctctgtctctttcccccctcccccactttctctcactgattttgatgaggcaaattgccatgttagagaccgaaggaactaaacgtggccatcagccaacaagaaaaggaagactacagtccaataacccacatggaactgaaacttaccaacaacaggtgagtttggaagcaggtccttccaaggcaagctttcaaatgagaccctagccctggccaacacctagtgtgcagcctttgtgagagaccccgaagcaaagaatatggataatctatgcctagacttctgacccatatgtatcctgatactctaaagatacagttttaagcccctatctttgtagtaattgttatgcagcaatagacaactaatacataatattataatctttttaagaaacaaatatagtaacataaaaattaaataatggtgaagttgtagggttttcagtataggagtattgcaaatataagaacggaccatattttaacgagttactgaaaaatagtggcgaattttaaagtttcaatgtcagaaagaagaaatcaaatatatactcagatgaaatgataaaaccattaaggtttcatgcaccctctcacatttctaacattaattttcaaattttaagtagaacagtgataaagatgaataatattgtcaatcttctagttttattttagcaccttgcatttaaaacagacaatttatctttgagttgttggtacttcaaatagtttttttaaagtttccacaatttcacacagagacgaatgctaagaatctgttaagcttgcttttagggaaaaggatgcctcaaagtcacaaaactttttaaacttggttctttgggggtgaaaaagcaggcatatttttcaccaattttctaaattttacatgttaaattggaagtaagatttatgttaaactgtttattaaaacatattaaagataaaccatgtgagagaatggaatcaaaatggagaatttcctaccttgctcacttcaaccaattaagaacataattggtagcaaaagatgaagagggagatttcaggtaaaagagaacagaaattaaaaaaaaaggaaggggggagaaaggcaacagagacgagatggggaaaagagcaaaggggattaacacatcttgagagggtgagatgaaagtgtgaggaaaaagtaaaaaattatagcatgaaaatagagatgtagtgtactaacatgtaatatagagttgatgaagacatgttggaattaacttctgaaaattgttgatgaatgcacagtttagaaatgacgaataatagttctattccatttccatttaaaggataaaggcttcaaaatgcatgaaaaattataaagtgaatttttaaatggttcatgaaatctcagctttctgaaactaaattagcttcttttgtttttcagattcgaaactctatgatatggtttggctgtgtctgtaccaaaagctcatcttaagctgttgttcccataacccccacacgtcctgggagggatcaggtggagataattgaatcacggcgggcggttaccctcatgctgttcttgtgacagtgagttctcacgaggtctgatggttttataaggggcttttccctcttttgctcattctcctccttcctgctgccatgtgaagaagaaggtgtttgcttccccatctgccatgattgtaagtttcctgaggcctccccagccatgctgaactgtgagtcaattaaatcactttcctttataaattacccagtctcaggtatgtctttattagcagtgtgagaacagactgatatatttcattccatacaacaccaaccaggtctcataccaggtcttgtagatgataccaaataaactctctgaaacatatttttcctaattctttttgtcccattgaattgtgaaattgtacactttcatctacagcaaatattggaaagtttctgcatctggaagattttgaaagtgaaaagaattatcttatattgccatgaatgacacagcccttgataaatgagtaggaatatgtgagatatttactttaaaattgtctttaaaggcaatatccattctattattgacatcataacattgagtgaacatattatcagccagatttagtaaaactgtacagtgaattttccagagatatccttgtataacataagtcatctagtctccacagaaatgattgaaattccttgactagactaagcagctccattggttacagtaaatccaaacaatttccccctccaacctcaccttctactttatgctcacatctacttttgtttatgatctcaatttcaggtccatgtcttaaatgtagacctactaaaataggacatttactccaaatttcaattccttccctggttgcagccatgttttgagacaccagaatgtaagacacacagaaacagaaaatactgtggaaggaagaatcaacatcttttcaacttattgtgatataaatttgaaaagctatgacatggaattctgattcaattgatatccatgatctccttgtaagtacctgagtactgaagccaactgtcttgatttgggtctcccagtagcaaacccagaaataaaaatttgagctcaagtagttttgggatgtgattccaggacacatcaacagggtgagaagaagtgaaatagggaagatagccaataaagggtatattatcatgcaagtcatcaatgtgaacaactgaatcttaatactccctgttatccctaaaagaagatgtaggaaactaaggctactgtaaccaaaacagcatggtactggtaccaaaacagagatatagaccaatggaacagaacggaagcctcagaaataataccacacatctacaactatctgatctttgacaaacctgacaaaaaacaagaaatggggaaaggattccctatttaataaatggtgctgggaaaactggctagccatatgtagaaagctgaaactggatcccttccttacaccttatacaaaaattaattaattcaagatggattaaagacttacatgttagacctaaaaccataaaaccctagaagaaaacctaggcaataccattcaggacaaaggcatgggcaaggacttcatgatgaaaacaccaaaagcaatggcaacagaagccaaaattgacaaatgggatctaattaaacgaaagagcttctgcacagcaaaagaaagtaccatcagagtgaacaagcaacctacataatgggagaaaatttttgcaatctacccatctgacaaagggctaatatcgagaatctacaaagaacttaaacaaatttacaagaaaaaaaccaacctcatcgaaaagtcggccaaggataggaacagacacttctcaaaagaagacatttatgcagctaacagacacatgaaaaaatgctcatcatcactggtcatcagagaaatgcaaatcaaaaccacaatgagataccatctcactccagttagaatggtgatcattaaaaagtcaggaaacaacagatgctggagaggatgtggagaaacaggaacactttcacaccgttggtgggactgtaaactagttcaaccattgtggaagacagtgtggcgattcctcaaggatctagaactagaaataccatttgacccggccatcccattactgggtatatacccaaaggattataaatcatgctgctataaagacacatgcacacgtatgtttattgcggcactattcacaatagcaaagacttggaaccaacccaaatgtccatcagtgatagactggattaagaaaatgtggcacatacacaccatggaatactacgcaaccataaaaaaggatgagttgtttatgtcctttgaagggacatggatgaagctggaaaccaacattctgagcaaactatcacaaggacagaaaaccaaacaccgcatgtcctcactcataggtgggaattgaacaatgaaaacacttggacacagcgcaggcaacatcacacactggggcctgtcgtggggtggggggctggggagggatagcattaggagaaatagctaatgtaaatgacgagttaatgggtgcagcacaccagcatggcccacgcatacctatgtaacaaacctgcacgttgtgcacatgtaccctagaacttcaagtatatatatatacttatatatatacttatatgaaagatgtagggaattaagcttggagttattagatctgaagggcaagggggacagggtattgatctatcaactgctgctctacaggggcataactgctacatttctgctctctcccaagaatgagcagagatagccccaagcaaagagatgcaagtacaggaagttggaaattaagaagcacgtataaaaatggtaagtgctaaagggatatcggtggggcaccgacagtatctgctacaacacctcatacattttttccttaaatgatctccacaacctgcctacatttggaaagtattgttgtaatgtcaaaattaccattcagtttcattaattgactaaaaaatcaagtcaaagcaatgtgacagatattggttggttatcttttcctaattcatctatctattctgtctacctgtctgtttatcagtcaatcatctttcacccttacgttcctttgaggaactttgcacctacttctctacctttgttgtggtgcagctgtagagtttggttgagatttaatgacttttagctgtagaagtgaggtgtgatttagtacaggaatgagcatgtgacctaattcaggccagtcagtttcagagcagtctttcctggatgctttgggaaagaaggtccctaaagagatgattttcatcaaaagtaagtttgcagatgtgggttctgaaacggcttcaggccatttttgtcaccaagagggaagtcaggtgaagctgctaggtcaacacagaaaaatagaacccagagaaatgtgaaaaaaaaaaaaaaaaaacaagaaacaaaaaaccggaaccttgatcatatttattgtttaaatcagtttgagaccagttttctgtcacttacagcattaagagaaccaatagacgcattaagtcagttacttacaggcatattagttagaactaatcctccatgacacttcacagaaggtgaagattcatgcatttttaaaataattcattctatcattttacttgaatatcataaaaatctctcggttagtgttaacaaataatagttttctttcgtttttctaacacctaaaaccatatttcataatcccataatgtgaaatagtgtgaataatatgtaacagttcaaacattatgttccagaagagagagatttttattttttctttctattttttgaactccagagagagatttttaaatttgcagtttgagattagagctttccaacagctgaagtgtttactattttgagagaagacttgcgaaagcaaaggttaacctagtagtacctgctgtgccttcgttggcaaatgaaggaaaatcacacagatggtggcatttgcctgggagttgggtgccaggggtgtcctctcaaaggcacacaaaaagatagaatgaaatgtctctcttttcttaaatatgtggatgtggatttgttggaaaaaattactttacccacacttgaaaagtcatcaccactgtcaccaccaccacaatcaatcaatttaatagtgaacatgtattaatcctttagtatgtaccacattctcccttgccaggcaagcaaggaattcagctttgttctagactgctgtttggcacagtcttaggttattctccttctaacagtgcaaagcacttagaatacagtcgatacacagtaagttattaataaatattaactatcattacctaacacactgaggaatctttaactctcccaaggagtggggaggacttcaaaacaggaatcagttaaatttctccttggaccgtctagtgcaggcttggtgtagatataaaaagaaataaaatattggtacaaactaaatgcctgacacatctgaggtagaaactaacgaacgttgtaagtgaaatactgctgtgggctgaggataacaggaggccaagatggatcttgtttggagatgacaaggcaggctctatgggattagaaaggagaagtcagatttagagattggtggtattaagagagaaggaaaaaaggtagactttctaagtggaccaggcagggaatcagaggcgaggaagaaaacagaacaaatggaaagaacattgggtagtctcattttgatggcagcctgagtgaaaatgaccagtgggagaaaatatcagaagatttctatagctgaatgacacaggggttggaaacccagggctaaaggagaaatttatcaaggaactgtttcccttactaaatccacagcatcgcccacataggtacagacttgtttgtctaggattttgtgactacatggcagtttgccttatcaaagtgagtgaaaggatggggaaaagggaaagcaagacaggaagagaaaaagaaatagggagagtgaggctcttgtcacaatcaacttgtaattgctgaacagtgtgttggtgctttcatgtcagaggtaacatttacagaaatgacacattttaaggccctgaggggaaggcagattaggatagaagcttataatgtattgctgctttatagttttatcactgtttggaaagtatttcattttatttatagctctgtaggaaaattactaaaaaaattatgataactaatacttactgatgtcttaccatgtgctgagctcaggtttcagcttcttaaatgtgtcattaggtgactacaaaagtaagtgttgttttcacattcatggaacttgccatttgatattgaaatacattcttaaataaatgtgattatgttatacatcattttaatgagcatttctcactttttttttttttgctaatgacttattacttgctgtttattttatgtttattttagactatggaaatgatgttagacaaaaagcaaattcgagcgtttttcttattcgagttcaaaatggattgtaaagaagcagaggcaactcgcaatgtcaaaaacacatttggccaagttactgctaacaaacgcacagtgcagtggtggttcaagaagtttttcaaaggagataagagtcttgaagatgaggggcgtagtggctggccatcagaagttgacaatgaccgattgagaccaatcatcgaagctgatcctcttacaactacacgagaagttgccgaggaactcaatgtcaaccatttcacagttgttcagcatttgaagcaaattggaaaggcgaaaaaactcgataagtgggtgcctcataagcagagcgaaaataaaagtatcgtcattttgaagtgccatcttctcttattctacgccaacaacaacaaaccatttcttgatcggattgtaacgtgcaacaaaaagtggattttaaacgacaactggcgatgcccagttcagtggctggactgagaagaagctccaaagcactttccaaagccaaacttgtaccaaaagtcatggtcactgttcactggtctcctgctggcctgacccactaccgctttctgaatcccggcgaaaccactacatttgagaagtatgctcagtaaattgatgagatacatcaaaaactgccatgcctgcagccagcagtggtcaacagaaagggcccaattcttctctgtgacaacgcccgaccgcacgtcgcacaaccaacgcttcacaagttgaatgaatcgggctaggaagttttgcctcatctgccatatttacctgacctctcaaccaactgactaccacttcttcaagcatctcgacaactttttacagggaaaatgcttccacaactagcaggatgaagaaaatgctttccaagagttcattgaatcccaaagcatgaatttttatgctacaggaataaacacacttatttcttcttggcaaaaatgtgttgactgtaacggttcctactttgattaataaagatgtgcttgagcctagttataatgatttaaaattcacggtcccaaactgcaatttcttttgcaccaacctaatatatctcagtccatttttgtagggccatttttgttcctgtttccaggtgagaaaactgagaccacagagagatgacacagctagtaaggaatttgtggaaggcgattatttggcagccccacaattaatcacgcctcttggattcatgcctttgtgtagtcccttctcattttgattctgaacttggccatatgcctggctttggccaatgggatagtagcaagtgtgatacaaacagaagcttgataagtctttgaagattggtgcttgttcttttggaaggcttcttcacagaactcaaccaccaagctgtggggaagccaaaggagacacatggagaagacaatggaaacaaactgaggctcatggccaatagctttagctgagttctcagctggtaggcagcaccaactgccagtcatgtgagtgaggccattttggactttccagctttcccagtgtcttggttgatatcaggtgaagcagatgaatatcatagtcaactctcagaattatgagaaatcgtaaaactatcttattttaagccagtaacttttagagtggtttgttgcatagcatatataactggaacagagtgaaatcaaaatttgaaccaggcagagtagtaacatgtcgaactaactatacaggattaaaaaaaacagcttctcaaagtgaagcagaactttatctttatttgttttttgaaataaatattctacattggctataccagactacgtgatatactagtatgctattttaccttactgtgtctctcttcctgtttcctgctcttatgtgaatatacagacaatcctttctggtgacattatctttgctctcaggaacaaagaatgaccttattacatttacctatatcatcactacccctttcacattttaattagcaccaaattgtagaaaaacaattatgtaaattattagcagagatagtggcctctctgtctctttcaagattaatatgactgagttgtggtgaagaataagtcaatgacaaggtcagcatccattccagaggaagattttgaaaaaaaacaaaaacaaaaacaaaacaaaacaaaacaaaacaaaacaaaaacaaaacaaaaacacttaggcatttggggaaaggctgctcttatcactgagacatttatttgggtaagaatttttcgataggtgtatctagaactagagaacttcagtgagctttgccttcaaaccaaatcacagtatcttctctaataattatctaaaaacaaccattgcctccacttctggactgcgtcagatccacccgttttatgctctcttgctttccttgtttgcatcaccacaatttgaactaagcaattattactttgatggtgggattacataaaaagcaacgatttttctcatccttgacttcaaaaagctttattgaatcatttagcttagcttacatttgaaaactcagaatggagtggtgggtatgggggtgtggagagggagagaagtactggatttatagtctaggtcttgcataggtggtcgtccagcacttactgctgtctttgtgcctgggctggagagaatgtggagaaaaggaaaaccttgcacactgttggtaggaatataaattagtacaaccactatagagaacagtttggaggttcctcaaaaaagtaaaaatagagcttccctatgatccagcaatcccactgctgggtatatacccaaagaaaggaaatcagtatattgacgaaatatctgcattcccatgtttattgcagctctattcacaatagccaaggtttggaaaaaatttaagtgtccatcaacaaatgaatggataaagaaaacgtggtacatatacacaaatggagtactattctgccatagaaaagattgagatcctgtcatttgcaacaacatggatggaaatggaggtcattatcttaagcaaaataagccaagcacagaaaaacatctcatgttctcacttatttgcagaatctaaaaatcaaaacaatggaactcatggacatagagagtagaaaggtagttgccagaggctgggaaggatagtggaggagtcggggagggggcagcgggatggttaatgggtacaaaaaatacttaggaaaaatgaataatacccagtattcgatagcacaacagggtgactatcgtcaaaataatgtaactgcacatttaaaaataaataagagtataattggattgtttgtaacacaaaagattaatgctggagggggtggatcccccgttctccatgatgtgattattatgcattgcatgcttgtgtcaaaacatctcaagtaccccataaatacatacacctactatgtacccacaaaaatttaaaaaaattttaaaaagagagaattggttgtggtaggagcagatagcataactttcactttataggtcactggaccatgaggaaccatatcttgatctgatggagaagacagtgcatcatccacagacaatggacttttagctggatgcagtaagtgaatgagactttgactggtctctcttgggaaggcactgtgtgttctcttgatgataagaaagagagtgcatggatatttgtgggaccagcatggagattttgaaatgcagtattatattgagaatagtatagctgccttgctagcctgtgttcctttttagagcagagactacgtacctaggctggactttatgtgggaaagatacacatatctatattgtttgaaacatggaaacttggggtatttttattatagtagctcagtctacaccctgagaaatctgaaaagacaatgagaacggctgcatttgtaattatataatccattttaatgtttgtccccctccaaatgtaagatccataaagacaagtgtctgtctgttcataactctatcctcattccttaacattataccatattggaaacacttaataaatactgaatgtatacataaaccaaggtactgtttctatactcctaggattttgcataaagtatctttgaggatctttgtgaccctctagactattggcttttgagaatattgatactgtgtcaatattacgtgagaatcaggattagttgattagaaatctgaatacataggaatgcatcttaactgaataccttacttgtgagggggtgagaaacttaatagattgcaaggtgtggtagattgcactggtgacctctctgtatgcacatctttttgcaatgtgacttttaaagttgctaccatcaggagttgtaacctatttccctaatccctgaatatgggcctgccttgtgatttgctttggttaaaaaaatgtgttagaaatgagtgagccagctccaagcttaagcttcaagaagtcttgtttccttctctattagaatcctgtttcttgcatgagaataagcccaggagcgcttgccgaaggatgagagaccatatggagcagaggtgaatcatcctagctgcgcttatgctagataagccagcccctagcccacccattagctgactgaaaatgtatgagtgagccagaacaacacaacagctcacgggaccccacagactgtgtgcaattataaatggtgataattttaagtcaataagttttagggtgatttgttacataacactattgcaaattttacactattggagttattacttaactgatatataggggaaagccagaaatgggagtgaggcttggtacagttaagagttcttaaataataccagagtcctcaatcctaaaattactgattttgattttgaatgagtatctaaagtcaggctcaattctttgcaaagatgtctgaagagacattcatggcaaatcaatgggggtaaccactgaaaaagtgattttagaagatcattattagaagacctaataatagctagtattttttggccacttactctgtatcagctgttgcccaaagcagtgaaagagggaaagaaataccctgaaatctccccttctcctgctctccaatctcctgccaacgcctcccactggttaaatctatacagaagatagttgagaagaaagcctgaggaataaggtgagtggaggtgagcttcttgcaatatacaatatattgcacagaaagaggaaggaaattgagtgaatctgtgggaaagttatacttgggttatgaaccccacaacgatctatgtttcaaaggtataaatcatttgaatgtgttcatattttctgtcaaagttgatatgtatcttctgtggtcggatgaatgtgcttcataaatatcaagagacaaaatctttttgcaaaggcctttccagtatctcagaacacactgtatgcattccattgaatgggattggtggtcaactcctacacagactcttgatagccactctctacctccctaccatttaagaagtagagcaaggggaccagggaaccagcatcttgaaattagggggggaaatgcagaacctcaggtcctatgcaagagccattgaatcagtaacctgattttaacaagatctcaaggtgattcctgtttcagtaagtcatcaattaatgttgttgatagattctgggaaactgtgacttaggcaaaatgacatataatgaaaccaatcttaccataggctaattgataaacaagaattaagttcctactgcatacctgtgttcacaaaacatgatccaacatctaaataaagaccccaagcacttctaatattaaactcagaaataaatgtgagatatacatccactttagaaagattaataaaaaccaggaggaaaattatttacccagtttttggtgaatcagtgagtgacagtgtttgcagtggcggtggttcattcaaggaataaatgtttgcaaagcataaactgccaggattgccttctctcaccacaaagttcaaaaacaaacaataatcaatatggcagctcactgagcacttctgtagagcatcaattattgtcacgcatctttatgattattgaatactatatgaatttttatttcacagtaatttatattaattcagtcattcattttccaagccacgtattccagttcagggacttgggaggccagagcccatcctggcaactcagagcaccagacaggagccaacactggcagggatgccattctatcgcagggcacagtcgtagacacataaacactcacatggggacaatgtagacacaccaattcccctaacgtgcacagtttgggacatgtgaggaaaccagagtactagaagaaaacccacagagacaaaagaaaaccccacatagacagtgcccccctagctgagatacagttttttcccttgccaatattataacacagtgatgctcaatgaaacaacattattcaaggacctgccgtacattaaagtttgagaagttctgctctacgtgatggcacgtggatctttaccccttaccactgctattagaattttatggtaacctactttgtaatagtaaccacaatttaactcctcgtaataaagtatgatagtatatattgtgtttttagttcctcactagacgctgggagatgggcaaacatgcttcataatgcatcactgttggacaaatgaggaactagaggcactaagagatttaaataagtggcccacagttatgagttagtgagtgttgaacctgggtctagactgagttatgaactgcaagtttagtgatctttccaggactgagatgaggcatggagaataagaaggtggaacggtggcactcattacacaaaccattagaatatttgaggccacgttgggaattaaccacacgcgaactgagaagctggaaaggggtatctttaagaaaactaatccttcacccgaagtagaaatgattatttaatcatactgcattctagtttcagcataaagacttgaacatgttaatgtcaacatctttttttttaatctttttttttttgtttgtttgagacagagtctcactcggttgcccaggctggaatgcagtggcgtgatctcctttcactgcaacctccgcctcctgggttcaaatgattctcctgcctcagcctcccaagtagctgtgattcaagtcatgtgccaccacgcccagctaatttttgtatttttagtagagacagggtttgacaatgttggccaggctggtcttgaactctgacctcaagtggcctgccctccttggcctcccaaagtgctgggattacaggcgtgagccaccgtgcccagcctcaacatctttcttaattattttagtaattaaaatagtttttgtctgctcccaaactatatgaaatcttacccatagagtgtcttttctattaattttcctgttttgtgtgttggcctttatttgttctcaatgaataagggcctatatagcacctgaatattaatttttttctcttccttaaccagcagctcagtgattctaacatcactgataaaatacacatcactgatgaaaataaaacaataaagcaacctctaggagataactgcaatggtctaaaatttgtcacaaaagtcatagcaccaacagaagcaatcttcatgatagtcatttacattgcaattgagttcagaatgttcattcttttataaaagtttcaataagtccaagaagtactgtcctattcaaaactgttgatgtcacccacatcacagtcagaatgtgtcactttcacaaaaaaatatttttagactgcatttgaggtataagcatcagtcatcagtcacaggttgcctgcagaatgtaaccatcagaacaaatagagttttcttgaaatacccttttgatgactttggtttccggcccatttgctggtccatctcttttcccaccacacttggccaaccatgccaaagatggactatacttgtcccggtgataactgaaaatgttcacaaattataagtgcaacattcagctcaaatgctttcatttccacaacaaaattgatggattttctctagcaacaaacaatgaaatgctctcgtcaatgtcttgtaattggttctaatatcagcaagccaatcaaaagggagaaaaaccaaatttctccatcaggcccttatcagcccttttgttacccatacagtggtcttgccccgaaccataaggtggataaatgaggggaatgctgattttggcatccagcttactttcagataatctagctcatccttctcagctgacacgagacagaaataacatcaaagggtgataaactctttcttgcaaacctggggttccatggttcactggccccaggcctaatccaacaatccattttctacacaataaaaggtaagaaacccattacagatctgttataagccttggcaggtggtatacggcaaaaatggaatacacaaccaacccagcatttggtatcccttttctatggtttgaagcactaggggtcagctgacatgaatatagtagtcagcatttagtattaagttattttagctacataaataaactcacatcttgatgtatgagtataaagatttgacagaaaagttcatttttggtatgattctgatctttaataaaaatcaccctgttattttacttttgtatggcatattggctttgcaggtgatataataaatgaaactgggttagaatttacaatatgtggtcttaaatatggcctttaatctttgttccttatttaacctcagtttaaggagttggcatatgaaaacttccatttaatatcatttcacgattattaaattattagaaaggaaggaaactccctctagtctcagggttggtgctatgtaagtaaaagcattgcagaaacaaaaggaaagaaaaaacattttatattagcaaaatccccttttattatgtcatttcttctcctttctagaagtcattgcttcaggcaaacacctttgtgctaataaaggagttacttaaaaatgctacactgaagatgcagagttatgaaatttttctcctcctttctcttttcatcatcatttatactcttcatcattttaaatccatcatgaacggggaggagagattgctaagaatagtcgaatttgtttttagttgaaaattagcttaacttttaaataaaatctagggcacagcatacttaagtgacacatttacatgcttgatatacattttcagtatgtagatagtggcaacaatgaagtttcactatggaaattagttgttacacaagtatcagtgcttcacaatttatgctggatttttgttatattttttaaaacattattatattggaatgaacaaattatcttgtatttggtgaggtttcctaatagaaaattatctagcttcagtgtaaccttctacaaatgcttttcctttactttgccaaaatgagggaaactgatgtcaaaaataaaggtagggggaagggatggggaagcagtgtgaaagtttacttgctttctgcttggatttctgggttacaatcaggccaatagattgataaaaacgatgttcagaattaaaagtcctctgaattatgttcatactttaaaagtgagaatgctggtgtttgaaaacaatgctggctttgttgggcttcttaggcaataggaggagaaaaatctatcattttccaacacattttagctgaaatgctagttggtcatagaaaatgaaagtaatatcagcggaataggagagcagtggctgaaaatcctctgtgccttccacgagagccatttggttgtcttgctgcctctaactctcctctccttcacctgttgcattcataatagtagcacatagttcagctttctccccaagagccatatttacaactttgattaagaaggtgagacttttggagaatttggaggtgagaatcagagatgattttgtgcttgctctttgcatttttctattttagtattactcctactgtttttaatctaacattttttgagcaattacaatatgccagatactgtgttacacatttcccatttactacctcattgaattttcaccacaacctggggaagtgtcttcttttagtatttgaattttatggatgttataacttaggtatggacagagtaggtataagatcacatagctggtagcaagtggaatccataattcataatctcatcattaatgcctgcagtaaattacctcctcatcactcctgtttactttttccttgtttgtaaagtgtctgatccatattcttggcattgcctatatggtattatagtacatactggtttctatccaggttcctggctcataacacccatagcccttgttacagttttttgttataatgttggttgcgttgggtctcaggggcaggcctctgaccttctcctgctctcctttcactttaatgttccctcgcctttcagattataggtcttaaaaacctcctgttagagggtcccaccatatacccttggggaaggaatgctgatgtcatgaagcttccataaaaaacaaagaggacagagtccagtgagcttccgggtagctgaacaggtggggattcctagagggtggtgcactcagggagggcatggaagctccatgcccctttccgtccctccaccccaaccatacctcaccctatgcatctcttcatctgtgtcctttgcaatatcctttatcataaacaggtgaaagcgagtgttttcctgagttctgtgagctgctccagcaagttagttgaacccaaagagagggtcatgggaaccccaacttgaagcccatgggtcagaagttccagaggcctggacttgagactggtgtgtgtgtgtgtgtgtgtgtgtgtgtgtgcgcgcgcgtgcgctaggggggtgcagaggaggcagacctcggtactgagccctcaatctatgggatctgacactatctctgggtggatagtgtcaggactgaattagagacacccagctggtgcctgctgtttggtgtatggggaaaaaaattccacaaatttggtcataaaagtcttcttctgtgttgacgattgttacgatttgagagtagagaaaaaacacggttagaaagaattttccatacacagcgtaacatttcaataatttggaaagttaaatgtcacgtattcttatatactattgtcattaaagagtgattaattcggtaataatggcaatcagatttcttggataggccgaaattctcagctgaactaaagtattaggaaggtagatgatgatgacaaggacgatgatgctactaagaacaaaagcaatcatgataataatagttattgagcactggaccaagcctagctctaaaagcctgatgtttgttctcataactagagtgaccctctctatatattttatcttctaaagtggaatacttatgacaatgaaagagggagctattaaaaattatgataggataacaggcaaaaaccagaacagtcagagcaaattgagatgtactcatgacacacaacctagtaataaacctcatgtcagtgtgaaattataggaggcaaagtcaaggatgcttatgttataaactttaaattactactcccttcccccaaccctcagcttcaaactgtttagcaactataaattagagatatgaatatttataatgccaagccctataaaattatgcatgtcctttaaataagggaagggtgggaagtgattatgatatgcttagaacagaatgtggcacatagtagtcctttaatagatagctcttgaataaataatttaattacagctttgctgtaattattaactacataaagaaaacatccaaataatggatttccaggaacttacataaagaaaacattcaagataatgggtttctgggaactatcagactatatgcccaataaataggtgaacacccttttttttttttttttttttttgagatagagtcttgctctgtcgccaggctggagtatagcggcatgatcttggctcactgcaacctcctactccctggttcaagtgattctcctgcctcagcctcccaaatagctgggattacagacacatgccaccacgctcagctaatttttgtatttttaatagagacggagttttgccatgttggctgggatggtctcgatctcctgaccttgtgatctgcccgcctgggcctcccaaagtgctgggattacaggcgtgagccaccacacccggcccgttttcttatataatagcgttttagcacacagatttataaaattaaaaactgtgtgaactgtgttacaaatacacttcaagggagaaaatcatgagcacataaaagctccagtggaactatctggtccctgctaagacttccagctagagaaatgatttcctataatgattattatacttcctactatatattttacagcatttttttttccggggttccataaataccagtcaatatggtaacaatgccagtgaagattctattatttggttgaaaaaacatcacgttaagggcaggactgaatggtaactattagaacaatctattaatcgtcatcttgtgataggaaattgattggacaaagtgtccatttttgagcaaggagtcggaaagccaagctctagctttatttaattttctcctttttgctattcacatttatactgacgactaataatgactgtcattacatagcaaatacgtctggaaaaagactaaacattcatttaccttatacaaatgaaaataaatctgaaatgtttactcctcagatacatatttagaagcaacatgattagagattaatacaaaatgaaccagatttctggaaatttagatacagccaactgtatattgtggaagatagtttgtgctaggagttgcactgtatttttactttcataatttttatttggtgattttttgaaaataatacctgtattattatcaatattacaaaaattattcccatattaaaggtttgttatatatgttgtatttgtaaacctacctttttcctcggtaaagtgaataagatgcacttaactaaaattcactttccagccaaatttcttaattgttttccaaaatgcttttttctttatgtgcaccattttatactgtctgggcagtaacaaattcaaatagtaatttaccatttacatataaacagtatatcttatttgtaaatggtattttatgtgtagatagtaaattactgtttacatgtaaaatgcgatgaaaaatttaaacttatttaacaaaatgacaacatatttattaaaactaataggaatgcataacgtacaccacctgtaaaattacttgacattaaaaatagtaggattttaactaattctgaaacaacataaacatgttttgctatattacacaactgtaaatgttccacagcagagaaggttctagaaagtaattttaaaacacagcatctagttctcaaaaagggcaaaaaccaaagcaaaaactcatatagtttttttaaaagaaaataaatccccattttaatattaggatattatccacataaaaatcacttgagcttcaccaaaaggttaaaacccctactgtttattttggaatcacttttatatttaaatagaaagctacatggtctcaaataagtcacataacctttctaggactcggtgttcaaaaataaagaatgataaagcatattttggttttaaataaatgggtagttaaaaaaatacccacatataacatatacaaagagcaatgaagaatgaggaaaggggacacaaaataaaaagacatgaaagagatgaaactgggattaacggggtcagggaaggagagcagaagagaatgtgttacataaacaactggggcagaaaaagagtggcaaatatgcaaatagaaaagtagattcatggccaggtgcggtggctcacgcctgtaatatcagcaatttgggaggccgaggtgggcagatcacctgaggtcgggagtttaagaccagcctgatcaacgtggtgaaaccccgtctctacttaaaatacaaaaattagccaggcgtggtggtgcatgcctgtaatcccagctactcgggaagctgaggcaggagaatcgcttgaacccaggagacagaggttgcagtgagtggagatcgtgccattgcactccagcctgggcgacagagcaaaactctgtctcaaaaaaaaaaaaaaaacaaaaagaagattcctaataaatatataaaaataaattcctataatatacgtgtcaattcatagatgaaaattagcctaaaagtgagaaacacagaggaagagagtgatgatgatggcgagagagcctcctacacccacatgcatgttcagagaaaatacaaagaaatatgaagagggataaatattaaaaacacctgagtcagaagtgtgggtgaagatcatagaatgagatgatcagagagaggaacacagaggctagctttaataacatccccactttgtggctcttacgggtatcattgttaaaggctgtaaaaggtcaagttatgtattagacaagaatgaggatatcatttcatgagccttcattgcatgaagctacccataaatttacgctaatggctatattcagtttaaagcaaccctgtccaccactcccttaaagaaatagctatattatcttcacctgctgttttctctcttcagtaatgaaatataaatgtacaggccgggcgcggtggctcacacctgtaatccccgcactttcggaggctgaggtgagcagatcatgaggtcaggagttcgagaccagcctggccgacatggcgaaccctccatctctactaaaaatacaaaaattagttgggtgtggtggtgcgcgcctgtagtcccagctactcgagaggctgaggcagaagaatcacttgaacccgggaggtggaggttgcagtgagctgagatcgtgccactgcactgcagcctggatgacaaagcgagactctgtctcaaaaaataaataaaaaaaaaaataaaataaaggtacaagagtaaggggtcagttggctcaatacgcagaatgcagcatattagagttagctgtggagaaagtcacctgccaactgattatgatattaggatatgtttggagatactatgtactaaggaattgacatattcatgtcacagtaactatgacccactagttccaattatatcacccactctaacctttggatgaagggtagggctggaggacacagggagggggtccgctttatttctaccctcctgtaataagtaagagcttgagatttaatgaagatcaagactgtctgccagtgttataagccattttcttttacttttaaaaaaacttgtgttatttacctaaatctggtactgatcatttgctttctatccctaaatctaaactaacagggatacagaggcatatggatggagaaaagatgattaaataattttaatatgactaatgaataaaattccaaatcctgtggcatttaatggcaaagacattgcattaaaattataattttggcataggaaacagatattatggatgctgtagtaatataagtctatacatgatggtgttcgtaacctcagttttaattttctatcataaaaatttgactttttattctgttgcaggacacataaaaccttgactctttcacaacccacaaagctgctattgtatattttagatagttctctcacatttcctacaattataatttttgttcttctttttgtcataagatgtactgagatattgtagaacattttgggtatccttcctccttgttctctttttatgagggatgatttcatttgtattgttatgtagctataaaatttaattgctgggacaccaccttccctccatacataaaagtctgtatctttacacagatgttttgcaatcattaaaggtagaaaccaagaagggatttttttttttcaaataactacctgcttgaaatagagacacttaagcgcacattatggttttaatgtcataaaattggtacttattttagttcctaaatattttatcagtcgtgtaaatgatctgttattagaatgtcagcatcaccaatttaaaaaatacaataaataacctgacacaattcaaaatgttcacaaattagatgactcagtatcgtaaagatgttgactgagctccagattcacaaaatttcaatcaatatcctggaaggctttatgtaaaaatagacaatatagttctaaaatttattcaaagaaccaaaagtagccaaggcaatcttgaataggaagaacaaagtggaaggtttacacaaccagatccaaaatgtttaaataaaatgattgcgtatatacatacaatggaatattattcagtcataaaaaggaatgaagttctgacacatgctacaacatagatgaaccttgaaaatattatgctgagggaagtaaggcagacacaaagtggcaaatatataattccaattatataaaagatctagaatagccaaattcatagaaacagaaagtagtccagaggctactagcggatgggaagagagagaaaggggaactattgcttaatggttacagactgtctggttggagtaataaaaaattttggaggctgggcgcggtggctcacgctgtaatcccaggactttgggagtccaaggtgggcggatcacctgaggtcaggagtttgagaccagcctggccaacatggcaaaaccccatctctactaaaaatacaaaaacttagctgggcatgctggcaggtgcctgtaatcccagctactagggaggctgaggcaggagaaccacttgaacctgggaggcggaagttgcagtgagccgagatcgcgccactgcactccagcctgagcgacacagcgagactctgtctccaaaaaagaaaaaaaaaaattgggggtggggcataaactgtggtgatggttgtaataaatgccactgagctggacacacgaaatgactaaaatgacaattttttatgttatatattttatcacaccttaaaaaagtaacaccgaaatacgattgaattgttcactttaaatgagtttaatggtatgtgaattatagctcggtaggattgttttaaaaaaaagattgtaattaagccagtgaagtactgttgttaaagtacagatttaatcaaatggaagaggatacagaatccagaagcagattcatacatacaagttctcttgatttatgacaaagatgccatgaaaatacagtggggaaatgattgtctttgaatgaatagtgctggatcaattgatgttgctttttactataaattcatatgtaccacttgctttatataaaataaatatgtattaatttaataaatagtattactgttagatttatatagtatgcaaggtggaaagatgaaaactcacaagttaataaatcagtaggtaagtaaataaataaacttgtggcgaacgttagtgtacattaattattaagtccataccacaggtgtgaataattaattttgatttatgacacttgtttaactagaaccagaccacgtcctttcagcttaaatactgtcagtacatgcctggccactgaattaaatacttcgccatttcttcagtctgattcttcagaataatttatgcaaaaaattgtggtataaattttggcatttggtcattaatgtaaagccattcaccatcatcattttttctagccacaacaaaacatatagccaaagcaaacggtcaggttaaaaaaacaaaacaaaacaacaatccacataccagcctcctccccgaccaatgaagcacccaggaaacaaaatacatacaaatacttgcaacatttaacacatgtgacggaagagatggttaatgtctaacctttatccactggagatttgtctgcttgagcttattttcaagtttatcttgctcttctgggcttatgggagcacttacaagcacgggtcctccagtttcatttaattgtttgagaattccctggcgcaggggcaactcttccaccagtaactgaaacagacaaatgcaacaacgtttaaaatgaattacagcacaattccaactaccttgtctttgcttctattgattagtctatcaaaatgaagcgacttgaccgagggcccagtggtacctcaaataccaacagttttctatctgagcacagagctgattgactgaaacactcaccccctcagtagataaatctctgtagaaaataaacgattatattatccctcataaattttttaagagaaaaatgtgagatggtaaagcaacactccaaataaagttagtgtctgaaaacctatctctctatcagaaatagaacaatgtgaacaaattcatcagcctcttgggtatcatagcatgccatagcataccgtagcttgctgctgagaaattgcattatcatcttaagaggtaactgacattgagagtattgactctcaatatacacagtgccaggcactgtgctaaccttttcacatttattatcttagtttatcttcatattataataattatatcaggtagatccaattatcttcattttatatggaaggaaactgagacaaaggggttaaataccagctcccaggacacaaatctagcaagcaacaaaggtgtggttcaaatttgggtagtttcattctggagtcctcattttttacttcatatccctaaatttctcgaactcattcaccaccacatagtgtatgccctttcccaagacctccaaaatcaccatggtgttaacacttcatttttgtcaactaaagttactgtgtctgctacagtacccattagccatacaacgctattaacattcaagttaatcaaaattcactaaaataaaatctcaagttcctcagtcacacgaccaactctccaggtattcaaaaggcacaaatagctagtcgttacaaaaatggatgatgcagaatattttcatcatcacgggagttctatttgaaagcactgatctagattctttcaggagaaaatagactcatgcatattaattaataagaaaatgccactaaatatgtttcgaatgaattatcaattatattactatatatgacactcaatacatttgggaaagataaatttccaagaaaagactgagttcattgttctagggtataaccatcttcaaatgattcccactcttttctatttttgaatcccaaatacctagtaaaacatcggatgtatagtcagtgctccatatttgtttattgaattacgccatattttatttttatactttatttcttgttcaggtgtaaacctcttgtttcacagaaataaacgtttgacattggactctaatttacatgtgtaaagcacctgaatcattgataaaggaccaatttcatttccctttgattatgtgaccgtgtaaaatgaggataatagcaaccattgtcaaaatctgatatgaagattaaataaaatagtggctgtaaatgtatctaatacttggcacataacagggaatgattaaatattaatttctcttcccctttcaccttctgcttgacaactaaaatgaaatagatccaaaagagctgctttcctaaaactaaaaccatgaaagttaatccaattgcacaatcagagcatgtcagtcagccaagggaagtaatcagtaataagcagacatcacagtaggacggtatgaaaagccactggaataagctggatgtctattcaaccaaatggaatgtgaaccaacaccacgtcccacacccccagacaaatcagctaaaacaaaacattgcttcgggggaatataatgcctttaagtagaggctgaagtggtgagactgatctggcaatccagatcttccctaagaaaatggattcttctttttaaagactcttctcaaatctccaggtaggtaaccaggacagattaaaaaagtgattcccatttagatttagattttatgattccacaatctggtcttcagtttttaaaattatatgaagttgtgaagttctcaagtaaaatctaaaattaatttcaaatcaaagataaaaactgtgaattatatacatttagacatattgaatctatacatctatatgtgtagatgtatagatgcaatatgtgtgtgtgtatatataaatacacacacacacatatatacatatgttcttatgtgcactggttcagaactgcagggttaagaagaaataaagttgtgagaaaaacactttagcaaggaactatgaataacctaatgggcagaaaaccaatgattgaattaaaaaatagattcatatacttctttatgcaagcaggccctgggggatttgagaaaataaaattaccttgacttgctcaagcttttcttttagttgctgctcttttccaggttcaagtgggatactagcaatgttatctgcttcctccaaccataaaacaaattcatttaaatctctttgaaattctgacaagatattcttttgttcttctagcctggagaaagaagaataaaattgttatttttttttccaacatagttctcaaactatttgttaatgcaaactgggacacaaacatggcaatttaaaaataagcaatttaaaagatgttaaccatacataatttaagaaaattcattcactttgaacaaagtaatttcaatatttcaagaatctctaaatgataagagattaaaatcgaacaagaaaaattctgattcaaaaattcctggccaggcgcagtggctcatgcctgtaaccctagcgcttagggaggccgatgtgggcggatcacttgaggtcaggagtttgcgaccagcctggcaaatatggtgaaaccccgtctacactaaaaatacaaaaatttgccaggtttggtggcaggcgcctgtaatcccagctactagggaggctgaggcaggagaatcacttgaacgtggaaggcagaggctgcagtaagccgagatcgtgccactgcactccaccccgggcaacagagaaagactccatctcaaatacatacatacatacgtacgtacatacatacatacatacatacattaaaatgaataaaataaaaattctaacaacattatgtcattatatctgagcaaggtttctcaactttagcattactaacatttaggtttggaaaattctttgctgtgagcagctatcctctgcattgtagggtatttagcagtatccctggcctgttgaacacactggataccagtagtaacacctcgcccctgagctgtgacaaccaaatatgtttcaaggcactgccaaatatgctggggggttgggggtggggacaaaattgtccctggttgagaaccaactaaagtaagtatataacctaaagttacaagttttaaaatgtttaattaaagtatacttatggaaaatgagaggacaaaaatataaacaaggtttttgttttgtttaagtagcagccattttatctgcttcttattctgtgggtcaaggatttggatagggctcagttgagcagttctgctttatgtggcttcagcttggtttaaaataaaacactaaattattacatgctaaactgttttccgaattatgactcacaaccttatttgaggaaagagaaaaactgatttaaaatacttaacatatgttgtactcgtggaagttttaattatgaaaatgcatataactctatgctaattagccataaatttattcttacatattcgattgtaagacagctgaacaaaattgtttgtgcttaaaataattgaaaattttttgttttgttgtcttttgggaactatgtgtagcttccatggaagcttttaactgaagtgtaatatacgtacaggacactgcacaatttaactgtatagcccaatagtgttttaaaaattgaacacactgtacaaccagagaaggaaatagaatattatcagaatctcagaaatctcctcttatccctttgcagtcactgcctccaagtataaccagtaccctgtcaactttgattattttgccggtactgaatattatgaaaatggaattgtatggctttatactcctttgtgtctcgcctttttcattcaaaattatgtttacgataatccatgttgcatataattttagtctgttcattaacctggctgtatagcatttaattgtgtaaatatagtactttagatggacatttgtgataattcagttttttgaatgattagctatttttttttttttgcttcaaattaacaaatgtgtattgggagcttactaccttctaagagctcaattgggcattaggattaaagatatatacgttatataccttgtcttgaggatttcatagtcaatgagaagaaacaagcatgtaagccaaggattatgattaagtattataggaggagaagttatttctggggcagtgcttgggagacatcccagagaagataatgatctgagtcttgaagcatgaagatagatcagcatgttgcaggaataagacacagcctgttcaaagacagggccttgagagaactacagttgcgatcattctgtaaatcagaatctggttattggacttatgcttgcatatattcattcagttttcctatatgataagagcctgttcaaagtctgttctgggacacgtaaagttacattctcccctctgtctattctcttttaaattcatttatacatttattcgcttatttttacaaatgtttatgatttattgtttttaatttttgtagggacatagtaagtgtatgtacttgtagggtacgtgagatattttgatacacgcatgcaatgagaaataagcacatccactgttcattcctgggacactgggagcagggtctgtttttaacctatcccgaatataacatctgatctagaagtacttctgccttatctgactgggaagatgaatgctatttacttcagctgagagtatattttgttgtctcatatattttggggaaactactagtttaataaatcaagagatctggagctcggggagagaggaaagctggaaataaggactttagtcattagcaatcagttggcagagaaaacacggtaaactaacttttgaactaataattaacatttcatgtttgctattttctgagtccattctttcttcgttttatgaattttaatcattgacaattctctcttatttaaattgaaaaataggaaaagtcaatttcaaagccttttgttgatttcttatgtatggttaaccttacggttcctcctcttcttctactctatgtgcttggccatggaaagccaaaggaatgcctacggtgctcttctggcctctccaaaagctacacagacctgggaaggaggtctgcagattccaaacattcattgaagtgagaggatgctttttccttcttggagtctacatacttactctcagtgattctctcgaagtctctacttctgactcagagagatgaaagagaaggaactgtcccttaccacaaactgcactccccacaaagcttactaccccttcctacctgagtctttttaatcttgcctgggacacggagtacagaggagattggaaattgcttggaatagagataataatccctgttgctttagagtaaaccctatggggaagtggctggtctcgattgctggcagtttgttttagaatgtggaacagcaccatttcccctcagattctgaccttagaatcaattgtggaagaagaaaacgtctagtatagtacaggcatcctttatttgtttaaatgttccaagcagatttaattccttgggtctagattttgagggtctatctcatctttttctctctctctgtttctactctgcaaatcattgcctccattactatttgactccagatgattttgcacagtgttctgaatacttttagttaagtaaaatcttgctaaaatctgattacatttgaaaaacctagacacattggcaaggcttttaaacattttcaactttcatctagaagcagacacgtttaaggaaaagaaaaccccaaaccccccaaacaaacaaaaatttaaggagcaggaaaaagtaatatcaaaccaaaaaaataataataaccctcaagtttagaaaattctaaatcaaacactcccctcttttcaaatatgtctcaaattatttactagcatatttttttctatcaagaatatccagtacagaggagagatgttgtgcttattcatcatagttgagatttatatgtattactgggttcaaaccctatattgtatgcttattttcttcatttattattctactatgtgtctctgtaggtcattaattacgctttaaaaacttgattttttaagatcctagtaataagatatataggggtaccctatatttcaccattattgtgttattaggaattttgtttgctttcattttttattataatgaataaccctacaataaacacatttatttatacattttgaatcatgtatctgctggaatgagaatgaaaagttaacaatgggaatcctaaggatttagatacacattgttgaatttctgtcaaggttggtactcagaacactcgtaaactcccaccaacagttacaaaatacttgtctcactacacttttgccactattgagcattataattgatataccaataaaacaaataaaaagcttgccatagatattttaagtattctactaataggaaagttgaaaatgttgtatgtgtgtacatgtttgtcatttatttagtttccactgtcaattatcggcaatgtctgttgcccatttttcctgtgttttcctatttttaagagctcttttcacattatctgaaacatagattaattgagactacgtttccagcttcctttttgccttttagtagttttttctaaataaaatttaacagtttatttctttgatattatgttcattgatagtatccttaaaattgtggccattttaccattgttcagatattctcatttattcttgatcctttactctttcatttgttaaaaaagaacaaccaaatatttaatccatcttaaatttatatagtgttgtttctaaccttgaagagtttttcagaaactgatattttttcccccagcaccatctcttctgaattgatttatggtgctttcttcatgatattttaagtttctgcttgttgatctactgtagatttttgtgacagtaatgcactatgtcaattattgcagctttaaaatatgtttaatttctggtaggttaacccgctctcccactttagttattctaacttatgtaatgtatcattcagtcaaattataaaacaattctcgctgaaaatttttaaatgggattgcattatatcaataagttaatttgtgaagaattactgcctttccaatataattctgctaaactttctgtatttacagtgttcttggacacagagtatctgggactcaatgggacactataaataattaagtacattttataattaaccttcagcatcaatttgaaagacagcatcttgcatatgattttatggatattaaccatatactaatttagaaaactcttaagaactctcagaataaatcatcacttaaacagtaaaagctttggctaagctttttgctgtctttctttttacacgatatttgtggaaaactttttttccagtgatttaattttttaaaaaaacagcatcttttaaatatgaaaacatttggtagtcatttcttatctagattttttttatactttgaaatataaaaaagatggtgacaaaatcccgttgggaccttgttataatctgcttttccaagcgcatgtgttttctgaaatttcaaaagcctcgatttgaagttttaaaagctgcaatttgaatttatgtattcagatgattgcagaaaagcaaagaaacacagttagcatttccaggcttgtctcttgacagaacagtttaaacgtgcttcatattggcattcatcacatgaagtgttatttctttgtttacctacttgcttaatgcttatgggaggatttattcagacaagtggtagtaataataatgagtgagatatttaacattacccatctgcaaataagtgctaaatattttacttttagaagcatttcaatacatttagacatttagctttttttagaaagaatggcttctgtttgaaatattggctctgttaccatttacattacaaatgttcccaatgaaattaaaggaagcacgtattacgatggtgagagatttgcataatcagaaaggaagcgctactcatgtgttgctaaattcaatgaatttaacattaactcttaatgaacattttctgtcgggctactcttacgctaagaggaatagactgccaaatcacatggcatgattttggtgaggggatctaacaagtgtttcaggtaaagtgctagatagtttcacagtggaatcttttaatattccatacatcctttggattgccttttatatgctttcaatgaagaaactgaagttctagagattgatacatcacatacccaaaggtgactatcccattttccaaatgagaagtccctctctccaagttttttgatcacctttaacatagaaactttagaaaatggagatacaatgatcacctgtttacatataatgtttaattcattaatttgattgtgtgtactactttaaaattatatagtacaaaatattatgtcattagatcacacttcttcattcatatttcatgcaacaattttgttcaaattcttcacaggcaccttcaacattgaaatttgcatcctcatggatgcacttgttgttgcctaactcagttttccagagggcatcatctttacttacatccatgtggcctgaggtatagtactgctgaatctagaggtaatgtttcactaggaattttactgcaagccacaagcacacatttacataacagaatacagttttatgttatgtaaagacagctttatcttttttctgtgccatatgtccatgagctacaccatgtaaccacttaatgagttacttttaacagtattctttccatagcttgtttacaatggcatccaactcttgcaattgtgatgtcatacaaccaaagtcaatccctaaactgtgttaaatttattttctcccagtgtgtgtgtgtctgtgtgtgtgtgtttttgccctcctctatcaggtttacttctacaagcctccaaaataagcataaattgagaataagtcaaggcaatacatctttcccggacagtactttgttgttttgattgaagtaaaataaatgaccatcttgtaatttgagaaacttcagaaggattcaagtataagttgacccttcccgagggaaaaccaaaacaaaacattgatttctacacacacctagtaacctcctcaggccataccctccgtaggtcattatcagaatcagaacccaagcatcaactttatttttaagccaacatgtctaccatacctggttggtgcttgagttgtacaagtagacatttgttcattttccctaaagtttgtgtcttgtcggaatgaagtgctcctgagggggataatatatcaagatttctcagtcatttatgcctcactattaaggaaatgattagcaacttttgagtagatgtggaaaacgatgagggaaaaacctgaaggttagcaatgcgaatatctgtatggaaagtaagtccaaatctaaatgctgccagttatcagctgagtacgtgaacacgggcgagttccttaatctctttagccctcagtttcctcgtcttaaaattagaacaataaacattttagagtgttgtgaggattaaagttttttttgcagaaacccaagatttagcctagtgcttcactaacagcactcaaaaaaaatggtagagaacataaaaggaggtacaaaaaagggaaaatatggatacagagctttctgttttaatcctagaattgtgtctaagcccacgtgcttacatagataaaagtatttataaaacattatgagtacacaggaggagtactcaaaattgaacttttgatgagccacctgacaactttatttctccctactgacaaactaccttgacaaattttgctggggaaaaaacaatagagaattaatgtcaatctatgagtaaatgtgccaccagatgagactacttctaggtgaagcatatatgtaatcacaatgcaacagccatttattgagggtctactagtgtccattgatatggccgtgaatatcggcagcaatccctgcctcatggaccttacatccgattgggaggaaggggaggcagacagtaaacaagataaagaaataaaatctatagattgtgatacagtaagtgttacagaggaaaaaaatgaagcatggaaaagggatggaaatattgaggggaagatggggagcagttgtgattttataaagggtgatcatagaaggttccatggagaaggagacatttgagcaaagtcctcgtggtagggactggctagctgctcattagacaagtctactcatttctcttaattgtgcagctagctgtcatttcccagtctcccttgccattagtttggctacatgactgagttcgagccaatggagtgtgagcaaaagtgatgctcatgaatatgaagcctggctcataaccccacctccaataaccaccaccacatatgtaatattccttgttctttttcattcttatgtacaagagcacagtgattttgaaatccgtatgttaaagacatcagagccacaaaagcgaagtgccctgggcccccctgatccaccatttggaggaaatctacttgttgaccagaaaatttttgtaaagtttgcatgaacggaaagtttctattatgttaagccactgaggtgtgggcttttttttttttatagcagctttaataaagataggtaatatagaaataaagaagcgagggaggaggccatgcaaatattgcgggaaagaacgccctaagcagagaaaacaagtacaaaggccttgaggcaggagtgtagtaagaacgtcctaaaaacagcgaagaagtgaacaagaagttcagaaatggagtgaggaaaggagattactagatgtggcccaaaagccttctattcagagattctatctggaatctgaaggcttttataatccctatcccacatcgaattcagtttctgggtaaaaataaattatagagcaatatgtttgggaaatctcagactgaactgtgttctccaatgctactttaatagatccaatcaactaactgagccctaggacttccccccagatttttgtgtgtgctgtctacacagttgctgaaacaggcttcgggaaaatctgaggatgctttggatcttcatctgtcagaggcagagttacatcacctatcagtaaagcctgtcacaaagccattaccatccgatagaaaatgcaattaagagggtatgacttcaaaccgttttttctgatttgaatcccagttcagtttttcccttcgcagacattcaaacaccatcatcttcctgcctaaacgtgctcctctgtcaagttcaatggatgactccaccagctcccggttttttaagctgaaagtgtagaagtcatccttgattcttctctctccctcactcccagagcgtatcaataagcatgtcctcataagtccacttgagaaatctctcttgaatctgcccacttctctccatcctcctgtcgctgtctccttcgctccttctcattctgatttcaacttttatttttgatccaggtagtatacgtacaggtttgttacctgagtatgttgtgtgatgccaaggtttagggtaaaaatgatcccaccacacacaggtagtgagcatagtacccgataggtagtttttcaacccttgcccctctccttcctcccccttctagtagtccccaatgtctattgttttcacctttataatgagtacccaatgtttagcttctaactatcttcggttttctgttcctgcattaattcacttaggataatgacctccagctgcatccatgttcctacaaaaggcgtgactgtatgctttttatgactgtgtagtattccatggtgcatgtataccacgtttatttcattcaatccaccactggtgggcacctaggttgattccatgtctttgttactgtatagtgctgcgacgaacatgtgagtacatgtgtctctttggtagaaagattcgtgttcttttaaatatataccaagtaatgagattgctgggttgaatggcagctctcttttaagttctttgagaaattttcaaactgctctccacagtgcctaaactcatttacattcccataaacagtgtataagcattcccttttctctgaagcctcaccatcatctgttgttttttgactttttaataatagccattctgttctgatttctaacagcctctctgagactgctttctaattagctcgtgcctcctaccttgtctccttcttatccactctttacacttcagaataagagatctttctaaaatatgttgctgatcatgtcctcatatactcaacaacatcctagtgccaatgggataaaatataacttctctaacatggtcaaaaagccctttgtgatctggtctctacttctatttcttcatctttctttgcactgtatagttcatggaacaacttactcttccttaaaatccagcactatatccatatcaggattcatcatacaatgttccctctgcctgggatgtccttccatacatcttcatctaggtagctccaggttgacctttccaatctcaggttagacatcacttcctctacaaagctttccttgattaattagacatccccaacccaggtataggtcacaggtcctgttatgtagtcccacagcccctcataatgtttccatcacaggaaatactgtaatttcccatgttcatcaaactattgcagattttctatctattgtgatcgcaccctatcctcagtacttagcatatagtatttgcttagttcctatattaataatctcctaatgacatcatcttaattgtatatctccaagtaataacattatttcatagtagtctggggagattttccatgaagaacaaagtgtgtgtgtatgggaggcaggttctgtataaaattaacgaaattcaaccagggaaagctatacagcaagtgtttgtaaactatggctcatgaaccaagttgtgctcaccacctgtttttgtaaataaagttttactggaacagagctacactcattcatttacatattgtctatggttactttcatgctacaatagcagagttgagtagttgcagcaaagattgaatggcccacaaagccaaaggcatttagtatctggcactttactcaagtttaccaccatctgctatgtgataaatctccttcttagacatctactagggaattaaagatacgagagttctgatataagaaaatctgtataatctctataaaccagtggtatgcgaagtcatgaaaatatctatgataattagaactactcctcaccccttgaaacaatcatgagcactttacacaattattatttcacaggacaaatagaaaaactagacattgcatctgattataaacattaattctgtttaaattcacgaacatttccaactatgagaaactatatctacttaccttagaatcaaacatggaaaatagtcaaaagacctatgcctctgcctcacttttcttgtcttggcttttacattatgccagtttctttatatttctctttcttcctaacccacaaccaactttatcatttattttataatttcacctcttttttgttactcagttttataatttcacctcctattttgttactcaatttttttcccctctgggctttatggtgatttttattactgtgtctgtattttgaattcctcgtggtagtaattctttccacccccagaaaaaatgtcatctgttttctcaaactatgtatgtttccagtggaatatgaatacattatatagagacggaaacccgaagttccccagagagtgagagagagagagagagagagagagagagagagagagagagagagagagaaaagggaacattttgatcatcactttcatactcgagcagaaaggcaaagggtatttccgtttcacttatttaaactctgcacataattgcagctaagttcctcagaaacagaggttactattctttaaaagaatatagccacaggaggtacaaaaatagttatattccctgaaacagtatttccttaaatgtggtctggggacccctgggagtccctgagacccatgcagtggttctgtgaggtccaaattattttcgtaataatactaagatgttatttgactttttcctctctcattctattatgagtttttcagaggctacatgatgcgagatatgacagcacattcaatgcagaaacagatataagaaccagctgccttctcttaagctaacttttaaagagatttgcaaaaatgtaaaacaagatcactcttctcactatattgtttctgttgtagaagagatagtttaaaaactaaacatttattttttatttcaacatgcaattttaaaatgaattaataagtaaatattttgaacaattaccacttttttttttttttttgagacggagtctcactctgtcgcccggctggagtgcagtggtgcgatctcggctcactgcaacctctgcctcccgggttcgagcaattcttctgcttcagcctcccgagtagctgggactacaggcgcccgccaccactcctgtttgtttgttttgttttgttctgcttttttttttttttttttgtatttttaacagagacagggtttcaccatgttcaccaggatggtctcgatctcttgacctcgtgatccgcccgcctcggcctcccagagtgctgggattacaggcgtgaggcaccgcgcctggccaagataattttttttgtagaaaaataatatgtccttgtcaactggcataagtaatgacagcttatcatgcatgccgagtttgtcattataaagacctcagacaagtaaataatacaatgtaaaatgaaaattgaaataatccattaggtatgaagaaatccaccacaaacattccagttggagttcagaaatttgccaatgaatttattagagacagagggaggtgaataatgtaggccaatgactatgagggtcaacttttagagttaatgaactgcctaaatatttactgggaatctctgtgatatgctaggctaagtagggcaccttcaaatgatatacacactgctcacttacagattatatttcactgaggcaagctcgcctgtcattaacttactgtattttatcaacaaatatttgagcatctaccacataccaggtactgattttgctacttgatgaggtagttaacaaaatgttgacaggctagtcagtgatacagatacatgaatgggtctccttttttttattgtttttattttttgagatggagtctcgctctgtcacccaggctggggtgcagtggcgcgatcttggctcacagcaacctccacctcctgggttcaaacgattctcctgcctcagcctccgagtagctgggattaaaatgcgataagcattgaagtgtagctatgcattcaccaaacatttattacacatctaccaagggccaggcactatactatttttgctggatattcaggagtgaacaaaacagagccagtccatacacgtagcttatggtgtcatgggtgacatcaacattaaaccactaatcatacaaaagagtttaatgcaaaccatacatatatatagaaaaaaattaagattgttaggagagtactccttttttacaaactttcactttcagaactttcataggtatgttgctcctaaaggcaaatatgcatcaaattttactttccatgaataaatggggtcactggtcagctatagttattatagtttttggtatcatgtctaactttagactaagatgtgtctcctctgtgtgtatttttgaaatgttttctaaacattattaatctcattatgtgccatgagtacaaaagcaaagcaaatttgttgagagtcctgggaaaacatagaaaagaagcaataataacaataataatcaaggtcctcaacatttataattttctcaaagggcttaactgaatatctatcggtcttttgaatggagacatatgttctaagaacaaaagcacttacagtcatttggaatataacctgtttctaagaagagcagtggatcttacttagattgaaaaggctgtggtggttgtaacagtgagtccctctgagtaagtaacattgaaattgagccctgaaaactatgtcaatatcagccggaatacagatggtacaagacaaaggaattagcttttatcaaggtagaagaaatacttagcgagtcagaggaattgaaactaggaattcagtgtggctaaagtttagagagaaaaatggagagttgcaggagctaagtccagagaaatggacaggtaatatcttctacattacctctgggcattaaaatttgattctgcatgaactttattagtgtattatttattttacatccatgtcaattactaaattcattaaaaatttggtacaaggtacagatgaacttagggagtctacctaacagattactcaagattggttttgatccttgaagtagaccacttcacttagctaagcatccgttttaaaatactagaatccaaagggtatcttcaaggatttcttttttaaacagacctagccatgtacaatagagtcaaggcagtgtaaactaaaatatgtgttttctggttctcagatcaataggacatacagcagactgacatagcacttaggagaaaatttctctgtatgtttacgaaaactgaagggagtttttttttttttctccactgggagctgaccatcattaccttccagctgaatctatgagagaattctgttcccattctcctgaattaatagttgctaagaaaatgccacataatttatttgctatatgacttaaaaggcaaagcataatgaaaatgagagtaaaataaaaggccattaacgagaaaatattgcatatataaatttgtgtcatatatatagtaaatttgcatcataccaatatcagggagaaaagtaagattaccttgtcaagcatcaagcacaagtagctaaaccttaaatacagtggataatgaggaacactgagataccaatattttttaaagcttctatttatttattttgagacagggtctcctggggtgtggtagcatgattatagctcactgtaacctccaactcctgggctcaagaaattctcccaactcagcctcccgagcatctaggactacaggcttgcatcaccacagtcggctacatttttaattttatgtagagatggaatgttgctatgtgcccaagctggtcttgaactcctggcctcaagcaatcctcttgccttggcctcccaaagcactgagatgacaggcatgagccatgtgcccagtcaacttttaattttcatttaacagctttattaagtatttaaggtgtacacgatgggtccataattaacaaacagatcttccccgactgactacgatggtttgacttacaattttgaagttcaccatggtgcaaaagcgatacacatttagtataatcctggactgaggatggggttatatctggatatactcactgtaagttgaaaatatcattaattgaaaatgtacttttgactcataacattttcaatttatgatgggtttatcaggacacaatcccatcctaaggtgaggagcatctgtatacaatgtgatgaattgggatataagcatacaaccatgaaaccatccccataatcaaggtaaccaagtatatgcatcaactccaaaagtttgctcatgcccccttcattttttctttcttcttcttcactttctccttctccttcttcttcttcttcttatggtaggaacacttaagacatatcctcttaataataatttaagtgcacagtacaggcactatgttgtacagcagatctttagaacttatttacattatataactgaaactttatactcattgaacagcaactcccagttcccccttcgcccagcccctggttactatcattctactctctggttctacgagtttgactgtctcagacacctcatataaatggaatcattcagtatttgccctttggtgactggcttatttcacttagcataatgccttccaggttcatacatattgtcaaatatggcaggacgtccttcccttttaaggccaaataatattccctgtatgaatacaccacattttctttatccatgcattcttccatgcacagctatgctgtattgatatcttggctactgtgaataatgcttcagagaagatgagagtgcagatatctttttgagattctggttttaattctttgggatatatacccaggagtgaggttgctggatcatatggtagttctatttttaactttttcaagaacctttctactgtgttctatagcagctgcatcatttttccattaccacctatggtgtactagcgttccgatttcctcacatcctcaacaacatttcttatctcttgtttttggtttgtttttatagtagccatcctaacaggggtgagatgatagtgttcatctcacagaggttttgatttgcatttccctgatgactagtgatgctgagcaccttttcacatacctgttggccatttctatgtcttctttggagaaatatatatttaaatattttaaaaatcaagttatttgcctttttcctgttgagttgtattaacaatcagctctgtttctgtacactaacaataagctacccaataataagcttttcttctattggattatcttgtcacctttgtcatatattgattgaccataaatataagagtttattgctggactatcgagtctcttccattgtcaacattaggagtgcagttagtagatttaagaaaaaaatatgaataggtttgtttcctaaacctacaggtgatctataagcctgtccttatgacagtaccacactgtcttcatcattgcagatttacatcaagatttgaaatcaggtaatgtcctgatttcaaagtcctctaacttttttcttctttttcacaattgttttggctatttggtacatttgaattgctatatataaattgtgggatcaatttttcaatttgtgccaagattgtgcaatttttcaatttgtgccaacatctgctaagatgtcgatggagattgcattaaatctatagaacaagttggggagaatcactaccttatcagtattgagtcttccaattcatgaacatggaatatggtcccatttatttagatttttaatttctctcagcaatgtattacagttttcagagtacaggtttagtacttatattttcaaatttatgaccatttaatctattttatgctacaaagaatgaaattattttcttagtatcattttcaattttttattgctagtacacaggaatgtaatttattcttgtatattgattatcttgcaagcttcatgaacttatcagatctagcagttattttgtggatatcagatttttctacatacaggattgtattgtctgtgaataaagagagtttcatttcttcttctatactgtggatgcctcggattcctatctttctcctggacctgggtttttttgttggaaaattttaaattactaattcagtttctgtgtttgtgttaggtctattcatatgtctatttttttcttgaatcagttttgttaatttatgtctttctaagaattttttcatttaatatgttttgcagaaattgttgacaatgttgttcatgttattacattctagtctttctaatttctgtagggttggtagtaattacccctttttcctttatgattttggtaattcttttttttttggtcagtctagctaaagcttctccatgtaaaaaatattttcaaagattaatgtatggtttcattgatttttctttcttcttcttctattttattgacttctgctctaacccccgttatttccttccttatgcttccttcgagcttactgtgttcttctttttctagtttcttatggcgaaagcttgagttaatgatttaagaattttattcttttctaaaataggtatttaaaactagaagtttccctgtaagcactgctttagttacatcctataaatcttgacatgttgtgcttttatttttattcagttcaaaatattttataatttcctatgtgatttagtttttaaccaatggatttagaagttgttgaatttcaaaatattttgatatcttccaaatttccttctgttgaattccaatttaattctgacatattaagagaacataatttttatgaattcaagcctgttgagtgtattgagatttgttttttgacctagcatagaatctatcccagagaaaatttcatgtgcactttaaaataatatgtattctgctttcatttggtggcgtctcctataaatgttagttaggtcaagctggttgatagtgttggtgaattcttctatattgttgctatttttctgtctaattggcctgccagctattgagagtagggtttgaagtctccaataataattgttgaattgtctagttctcctttgaattctgtcaatttctgcatcatagaatttgggactttcctattaattatatacgtttataattgttatattttctgcttaattgaccccttatataattaaaaatgtctttttctcttgttacatattttgtcataaagtctattttgtctgacattagtattgtcacttcattttttatatgtaaacaatttgcatagtacctcttttttctttgaaattatatggttttggctctaatacatttctcttttaaacaaactatggttggatattttaaataatcctgtctgaaatctctgcctataattggaatgcttagttcactcccatttactataactattgatatgtaggttgagtatcccatatccaaaatgcttgggattggaagtgttttggattttggatttctttagattttgtaatatttgcatatacctaatatcttggagataggacctaagtttaaacacacatactatatatatacatatatatatatatatatgtgtatatatatatatatgtatatatatatatatgtatatatatatatcttaatagatatcttatacatataacctggaggtaattttataaagtatcttaaataattttttgcatgaaacaaagttttggctgtgttttgactgtgactcattacaggtcaggtgtgaaattttccacttgtggtattatatcaaccttcagaaagtttcacattttagagcatttcaaatttcagatttttttaatgggaattctcaacttttagttgcaattacatgtgccatattgtattttttcacatcttattcatgtcttttttgttcctgtttctcctttactgcactgtcttgttagttatttttagtgtgtaattttaaattttgtttttaactatttattttcttagtgcttgctctaaagattacatatgcatcttaattgatcataatttacttaagttcaaactaatttaacacagtaaaatttagatatttttctctgctaagctccatttttgctcctcctgcttataaacacaataacacaatgttataatttttatgcaatcttaggtcttttaaagaagttaaaagaagaaaaacatatatctatatttgtacagtcttttatatgtatctacatatttatcagttctgtgattctttatctcttcatttgggttcgagttactgaatatcacttcttttcagcctgaatgactttatttagttttttcttgtaagtcaggtcagctagcaagaaatattctcattctcaacttggtaatatatttattttacctatatttttgaaggatagttttgttttatgcggaattcttggttggcaattttgtgttctctgagaactctgaatatgtcatttcaatacctctggcctctattgtttatgatgagaaattaactatcaatcatgtgatccctgtacatgaggagtcatttttttctggttgttttaaagactttcccatttgtctttcaataatttcaaatgaaactatttcaatagtttgactcttatgttttagggtattgatctcttcgtgtttattctatttggggtttgttgagcttaaccgtatttgtgaagtgtttggccattatttcttcaaataatttttctgcctctttaacaacattctctttttttctggaactcttgtaacatctacattgatatgctcaatgttttgacacaaagctatgactcatgttcgttttttatactgttttacctctgacattcagattggataatttttatttatctattttcaaatttactgatttttttttttttctgtcttactatctgctcttgagccccattagtgatttttttaaattttggttattctactttccaattctagaattttcatttggttcttttatatagtgtgtatcttttagttgagattctctatttgtagttattgttaccatactttcatttaattatttaaacatgcttttcttcagttgtttgaaggtatttatagtaggagcctttaagtctctatctgccaatacctgggccaattcagagacaacttttgttgactgcttttccccatgagaatgggtcacagttgaacgtatcgtaaatttttcttgaaaatttgacattttaaataacatattaaaggagccccaaattctgatgttccttcttatgcccagcgttttttaaattgaagttttaataacttgcctagatgaaatctgtggaatctgtttccccacagtgtgtggctgttgatattctttctctgtcaaacaacagaaacaaactgtatgcctagtttcctagaggtaagcatagcttaatttgcattagtcaatagttggccagcagttgatcttaaatacctcaagccagtaagacttccaagttttgctaaaggttctttatatgtgttaaagggtatattcaacatgcaggcacattttaagttttcatgaaggagacacaaggagtccttactgaggcctattacggctgcctcattttgcagatatgctggttaaattaaatttctggccagtctgccagtcagttacttgttccaatcaagactgcaactttaggccagctgagttgctattctgcctttttgtttgccgcctaggtctccaccgttactgacaatgcttctggacatggagttttaaacttctgcttcaaataaaatcagtccctgtggtgatgaagctgcttatttccatggcttgttctaccttgatagaactattatgcttgaccaagctgggagtggggactgggggcaatacaggcaaatacaccacaaattcatattgttcatatacaaagtttagtactttttataaataatcactttttaatttagcatatgccgttggttgatatccagggtcataagatgttttctccagtgtgtcccattttactgattcttggggagatttatcgagctactcactttatcatccccagaagtcatgtacccagacactaacttctaagcacctactcatgtgctgggcatagagctagccaatttatttacattacctcttactcttacaacatctctataaatatgtactattatctttatttttggattagtaaaaggaagctcagataatttaagtagctggtgcaagagaaaaaagaacaaattaaaaatataaacgcaaagataccatgttacatacttccaaaggtaataaacacaggtgggaagataggtgattattacccagcatttagttgccaggtttatgtaatggccaacctgaagtccaagtactctgatttactactgcctagtataaaggctaattagcaagaaaacaccaaataagtcagtaggagaaacaagctgtttttgtcatggatagactctaatcattaaaaaaacaatcattatattggctcataaagttagaatttgattcgcacatgtaattctaataaaatccagggtcccacgtgacccatattcgttaaagagttacaccaacagagaatcagcccagcaaaaatagatcatcaaaaaataattataatctcaatttacattttaaaattaatatagggaactcatctacaatttacagaacattccagaactttcatttcttctcctcctcacttttttttatacccatccagttcttcacaatctttcaacctctgaaacactccagaaaccgtatccacattcacagattctcttgttatctttatggggtagataaaccttgcttttgtagatactttccttttacacaatcgtcatttttccttaagtattctccaaattccacaccatttaaaatttataggatgaatggataaagaaaatgtgatatatatatatgcaccatgggatattattcagccatacaaagggtgaaatcctgtcatttgcagcaacgtggatagaactggaggtaattattttaagtaaggtaaaccaggcacagaaagacaaatattatgtgttgtcactcacatgtgggagctaaaaacatggatctcatgaaagtagacactaccttggtggttaccagagatcagaaataggagtagggagaggggacaaaggggaaaaataacataaatttacttattaccactgaactgtatacttaaaaatggtaaaggtatatttacttttatttatatagaggtatattttacctcaataaaattaaatttaaaaaattcaggccaatcacattggctcatgcctgtaatccccgcactttgggaggctgaggtgggtggatcacttgacctcaggagtttgagaccaggtgggcaacacagtgaaatcctgcctctaccaaaaaaaaaaaaaaaaaaaagaaatagctgggtgtagtagcccgtgtctgtggtcccagctactcaggaggctgaggttggaggatcgcttgaacctgggagatcaaggctgcagtgaactgtgatcatgccactgcattccagcctgagtgacagagccagaaccccatctcaaaaaagaaagttcataaaagcatatcaaatatagtacttttccttagacataagaggaagcacatatctgagaagacacaggcttgaagctgttaaactggcaaataatcataaatgtagtggggaatattcactttcttatttgttctaccctgtcgtcactattagctgctttgttcacatagctagatatggtcatatgtaacaataagggaaaaggcacagatctgggtctaaatcactgacttttagttctcgatccttctataactttggttagccttggacatatatcttgttttttcttgtgcttaatgtggtaatttgtaaaatggacataagaatgctgccatgctttgcttatgatctcgaagagtcaggtgagatgatggacgtataaaatctctataactgagatattgcgacaattaagtgggaaacatttgtaaaactcttatcaaagtcctgttcatagagtaaatgcacaaaacttagtgtcattaatactagctcttgtaacttccaaatttatagtttgggtacatgaatagatagtgatatcacccacagtagattttgggagaggaatataacatgttgagttttggatatactgactttgagatggctttgagacatagaagaggaaatggtccatttgaagctacatatgtaggtctaatctgaaactatatattgggccaaatattagacttaggccataaaatgaaatcggtgactttggtagagactgcttagctgcttagcccatgatccattccactacattttgaatgcccattgcagtttggcattgtcatgagaataaattctggccaatgacatacaagctaaagtgttgtgtagatcttccatgaagtccctttaaaagggtagaggtatcccttttttgtccacttcctacaccttgcagcctttgaaaagcagttgtgatagatagagagctgatagtcatcttgatccatgagtgtaaggacctcaccaaaggatggcagatctgtgagacagaagggatctggatcttcaacatcatagagcaatgataccaacctcggactacctactggcagattccttctacaagaagatgaatatatttctactttgtttcagttactataattcttttttaatctccctagatattattctaattgatacagtgaaagctacatttgttgctatggataacaatcagggaaaccgtatagaatgagaagaagggagggttcagaacatgtcctagagaaacatcaggatgtaaggggcaggtaaagcaaggagtgtcatcaatatagtaaggaattacatagagaggtaagaataaattcagataagattagtgacttggaagataagataggaccaagtgctaatacggaaagtgttcagttaatggcacatggcctacggataataggactaagatatgtccagtggatttaactacaagaaatcattgttgttattggcaataatggtttctgagcagtggtttggatcaaaagcaaacagcaaaagagaggagagggaaatgtgataatagagaatgtgtgtttaagtaacagtgactaactatgaagaagattcaaatgggaataataacaagaaaggggaagtaagagacatttgttaactttggttgcccagaatctgaatgccctgattatgtcgaacaaaatccccaaatacaaatggaatctgatgggggaagttcagtttttgaatctggaatgagtgacagaattataaggcactatctagaattctttccagtagcaatgacattcttcacccagtgtctgcagtggtagagtggtgcatggcaacgtttacatctagtgtatgggggccagacgtcgtggcacatgcctgtaatcccagcactgtgggaggctaagatgagtggatcgcttgagtccaagagttcgagatccaatctagggtatgatttggactatagttcttggagctgagcctcttttttgagttctgcccattttgagctggttttctatccctttgtttaggaatgggaacaggtctgtatctttctcctaaagtccgtttccgcttctatcaacaaaaactgggttctgttattcacagctatgaactctgacaagtacagtggaatgaatgcatttggaaaggaatgtctgaatatatttatattgtaatctaggagctaaaaacattcacctgatcagggatagtgaggcagcagaaaaagggtaaagatatgcttgtgtttgtgtgcattcaagagacagaataattaaccggggcaagattcctctgaaatgagagataaggctttctgctgaatataaggattgttatacattcaccatcataatggtaaatgataaattgttagattggcagcttacacaaatatagtactttcattttacaaacgatttttaaaaacatttatcatagtagagagagataaaataaaatattttaattcaaattaacctttgtagaaaaaatcacattataataaatttagacttatattaatggtcaaactatgacaacatataattagtaaaacaaaagagaattttaaagggaacatgataatagacttattatacatatctaagacatccattaactatattaaaccaaggtaaggaatcaataaaatgatcaacacatttttctcttaggactttgggttttcttttgtaaacaaaggtaggacactcacctgaggatagtgtattccttttttggagtgttatgatttgtgattctaacataaaaagaactttgtaaataagtgtttctaattataaaatgtgtctcaaaggacaggctttgagggtagacaattcaagtttcttcagcaacaaggaaaataaatgcagaatgccatttggcctgttttttttttttttttttttttttaaaaatggtacagtcttggtgcagctgctgttgggtccaatcaacagatagactttaaatgcaataaccttaaagggagagagaatttacagcaacccaagtaaggagtctgactggggcatgtatttctttgtgtttccttttcatgttatgggctctgtagctacccttgtattgaccatttgcagtatattcaaataaatgctgtattcatactttaaatatacatatgggcatctactctttccctagggtgccccaaataaaaagggctcatttcttatctgcaatctgtaggatgaaatctttgaacttattttcctgtatgttgtggtaggttttccctgatttatccccaatattttgtttgtcaacccttctgatttgtgatagtttacagtggtactctgtggccccataaagatcacccatatcactttggttcatttgtcaccactagtgctcatctgccacgttggcttcctgacacctgaactccttttccacagcagtgcttaatggttaatgtgtactctgggaattctggtttgtttactggttagcaaattaatgacttgagaaaggtaccttattgagaagcagttagttcaatggagattgccaccatctctacattgacagcaaaatggctcagtgtcttcagcccttgtcttcctcctgatgttcagacttacctattcaaatgcgtgttttctgatcaccttattttcaatgttccaagagctccttaagactattatatcccaagttgagctctgtatgtctgatttgctttcctctttccattcagttactctcctttgtatttcctatcctgactaacagccttccatgcagccagttcccccaagcaaaaaacctggaaaagggatcatcctagaattgtcccttcattcccctcatcatcccatctacttaacgactaaattgttccactttcatcaagtatttcttgaatctgtcaggtttttaaagttctattctgcttactcattgtctctaacttgagtcaccctgccactagtttcactctctttttttcactctgagctcaactgtcaaagggacatatgaggatgcaaatctaaagcatataaaaacgtcccaacatccttatattctaccctggaaaaaattctttgagatttcaaatcttccatgacctggtccatcttgacaatttcatttgtcatggcgtcatttttcagccttcctacatataaaaggaagtccccttatcaaacttgattagggtaagtggataggcggtttttggaaaaatattgtaaaattggagggattatataaatgtgtttacacatcttcaaacattttatttttcttagaatatacaagtggtcactcatttacttctcatttggtatggggtccgagacttttcctggagtaaaagcccacaggttgaagttaagcatattactttttgcataaaacacttctacatttcataatctgtgacttttagtttggtttctttgaattacagtcagatttggagatgctgaaaataatctcaatgcaaaatacctccattttttggggattctatccctcatacccaatcttaaacagttgtcttacctacatctaattcaacagcaccgtggttttttttttttttttttttttcctcactctgtcacccaggctggagtgcaatggcatgatcttgtctcactgcaacctccgcctcccgggttcgagcaactctcccacctcagactcccatgtagctgggactacaggcccacgtctggctaagttttgtattttcttagtagcgatgtggtttcgccatgttggccaggctggtctcgaaatcctgacctcaggtgatccacccatctcggcctcccaaagtgctgggattataggtgtgagccaccgcatctggccttttttttttttctaatcacctttatcaagtcttccaaagcattcaatttagtattcatagaaaccacaattctcttatcttttcatttctatttcattagttttcatgatatttaattaaataggacaattttaataataagaataacttgcatagccaggtcaggaaccacagactgttgcctcttggagaacatactctcaaatggtgggagccaaggtacatggtaccagaaaggatacttgaacacctttcaaaaacatcaataggttactaatatccatcaataggtttggagtgggaattgggcagtttatatgtagaaaatgaagagtttagggtaagtcaatggtgcttgcttaacagagcctttttatactgaactgtgtatagtccttcaatgtaggccattttttcttgcttcagtgattttgctcctgtcactttttctctctggcatgtccatttactcttcatttgcctcttctcatcctttaagacccatcccagagatcacgttccctaacaaactctccctaactcctactttcccaggcacataaagttcatggaaggccacaaataaagtacattcacttgtatatctccacacagtggtatcatcattaccagccaatgcaacaacatatttggtgccagctagtctgtttcactagaactagccaagttgaaaaaataaaatatgacataaaacaattaactatgaagctgatttttcatagtcttttgatgaagaattatgaatgcccttgaaagcttttcaagagtcatcagagaacagatgggaagagaccagcttttccattgacacctgtgaataataatatctgtatgattctctctgatcaatctaaaaatagctctttggtgatatggattgcatctaaaacatcttgtggctatatgtaggatgaggctaaaacattcagtttcagggctaattcctgcttaattcacttaaaaggtattagttgagatacagtgagagtaggataaacaaatgtacaaaatgtttgaatcaaagagctgctttttgccataactagctaaataaattgaagttacttgtctcttaaatgtactaaattctgaagaatacctaaaatattattaaccaaactccttccatttttttaagactagaagggatcaaggtcaatttctagaattgcaaacgtatccatggaaatgtgataacatgataaaaacagaaaaattggtctggctctttagatctatttttaatctatataataatgtcaagtgtaaagatttaaatcttcagtttaatctgaatgtgaataaaattcttacgatttaaattaagaaagtacttactggccatctacaatatatcaggctttctggtaagtactgtgggttatagagataacaataagagagtcctctgccctcatgaagcttttaatcttgctgggggaaaagcatatgtaaataggtatgatacatgatatatacatacaatattacatgagtgttataaaaaggggcaagaaaaccttaagagaataaactgcttatgtttgagaagagcaggtcacaattcattgaggtaatagcagttaagatgagtcttaagggatgtgtaagattttgggaaaaaaaataaggggaaagagaattcaaccaaaggaagcggtttttttttttttttgtcttgttttttgttctttgtttttttttttttgcaaaagctgaagaacagaaaacttcaggtcattcaaagcttcagacataaacagaaatagtggaaattatgaaaaacagggttggaaagataggtcagaacagattctatgttcaattcttttgctactacgtgtggccatcaaaggtaaggagaaggttggtaggaagaaattgcaagtgtataccagagaatcctgatggacaaaactgggataaataatgcaaaatctgatctagagtaaggactccggaggcagactgcgggactgcatcctggttcaaatacttgctggctgtgcaatcttgggcaaagagttttatcagtctgtgccttcgttgccctcctgtaaaattaaaaggagaatagcaactatttcatagagttgttataagtattgagctacgtaaaacacttggaacagtgcatggcaatattaagtgttatcaccatcacttccatcaccaccctaaccgtcatcatcatacaaaggtctgcatgaggtactataaaatcaaatatctatggaaaagcaattaatataaatgagcaaagtgggacaggtgctgcaaactgaggacaaagcttgcttaccccaggcaatgcttctcaaactttaatgtgcccatgaatcacttggaaacttggaaatcttattaaaaatgctgactgttatttattagattctgcatttcttagcaactcccaggtgatgtctgtgctctggaccagagaccacactttgagtagcaagaaaatgaaacatctgttactcagttgtaggtgatggtgccaagagaaaatatagtaatgagtgcctagtagccagatctaaattttcaaaagaagacagaaatccatatttttttaaaaaatgaggtctctcaatttttaaaagttgtcaattatttaaaaacagtggctatgcaaaaatactgcatgcattcaggattcagcctgtgggtactcagtttccaaactctgggctggatggagagtcaaggtctaaactggcaatgagaaaaaaaggaagtttgagtacagagcaagcggacgggacagatcctgggggcaaaatgtgaatgtgtgagcaggcttgtagcactggttcacacggatatactgggtacatttaacatattgcacacactgtaaagagccatttgagtcattaaaatattcgcttttaatttgtaggaaataagatgctgaaaagctatttggttgaaagctatttggttgggggtggggtctgaatttgtaagaagccaaagttaaagaaaacttaagagacaacagttgtcttacaaggaagcgcatagagcaatatgaattgctaatggagactttcaagaagaggaccaaccaggcctactttaatgaattagataaggctcatttctaatcaacagcgtgtatttgcatgcaaacaatgagctaaggtctttaaacaataatttcttcctttaagtacatttacgaatgcctcccattatcttatttacaccattaatttgcatggcaaaccagcatagattatatactagtacattttggtttaagaattcagaagtagagaggtttaaaggagtagtaacttaatgaccgtacatgaagtctcacacaagaagggctttttaacatgtctagacttacttttaacttccatgtattctgaaagagatttgtcaagaatcatttccaaggtaatctgaaaatattatctcctttgggactgcttgccagaaaggtgcacacattccattgagaaggggctactacccagatgtacgtttctacgtactattcacctctaaaagtaaccagagttccttgaaaaaaatgggtaattctaaatctgggataggcaaagtccaaggtgagcctgggacaattgagcaggaagctctgggcaagaataataactgtaattcataataatatattgaataaataaaaatttatgagtccattttgacataaatatagaggaaaaaccttttttttttttttttttcaaacagaagaaagccagctggtaaatgttaagatcatgtcagattaggaaaacctccattttgcaagccccagtgtaataactgagttagggaaggatcatcaatggatactaaagccattagatgatttattaattgcgaagaaaaaatgtgacattataatgcaagatctgtcagtcaccacctgaagcaagtaataaaactttgcagcatttagtgagactacttcatatgatgcacctcctgatgtgacgtaatacaaaatacacagcatctcatatgaagtattctcgccaaacatgtttgacatgcatctcttgaagtcttatttagacctaacttccagtttactagaaattcagagactacagaacaagttaaatcatcccatcaggggaaaaaaaataaaacaaatcctgaaagatgagacattttttgaggctagcgtcctggacattttcaaatttcaatatcggtgaaaaaaatgtggaagggctattttagactaagaaggatgaaaaataataataaccaaatgtaatgcatgagccatgataagatattggtactaactcccctgcaaaatataaaagacatttttgaactattaaggaaatatgaatatggaatggatattaacaataatgcagtattatatttaatttggaggagagcataataaacaggcatggttatatatggcatgtctgtatttcaaagcgacacatgctgaattatttaggggtaaaatataatggtatttataacttatttgcaaaaatgttaaaaagtgtgtgtgtgtgtgtgtgtgtgtgtgtgtgatgccctatatatgagagatacagaaagagggtagagaaagcgagagaaaaaaagcatatatggcaaaatgttaacaattgttgactctaagaatttagggggaggaaaacagtgtaaatgggcatatgttttgcaattgtttcaatttttctatatgtttgaaatttttcacaaaaagacttggggaaggaaaaaattcaaaattattttcattaaggtaacacttaaattaaaaccactattccttaatgcatattagtagaataattgccttatctgtgatatgggataagcaatatcagacttgtctaaaagaagaaagaattataatgttttgaaatcttaattattattgctaaggattatgattcagaggttcctcaatttaggaattccacttcccactgccttgcttccgtctcccattcaaacttttatcaactgacattattctaagtaaaatcctcttcattatgttgtcagcaatccattgcttgaaggcctggctccccagaacccctcgactggtatgtcttctcctagaatactccagaagaaaaggagtgtatgaagatagtgactgcacattaaaatgactgaaaccatagtaaattaggatgagattctgggcagataaacagacagctggctaggatcatttttttatgccttggacttctttggcaatctgttgaagcctgacattcctcagaataatgttttaaagcccaacaataagaccctgtagcacatataataagtactgcagttttgaagtagtgataagcataaatgatattttgatatatttattataactgtaatgagatgtgtacatatctgtgacttcataggtactgattgtactactgtgatttttttgcctactttcaaaatgaaaaggaatgcttaatttcagttagaggttagtaaagacaaataggtaattttcttctccagtgaagagcatggcgccccttgctattcatggacgcttgcttaaagacttgtacacaggcttgctttgtatcaacctatgacttccccttacagccgatgataggtttttatttgcacctccttcgtgtacaaagacagttttggtggctacgccatcattaaactcattattatcatgcttaagcctatagatgtatccagttcttctgttacataattgaagctgtagtgaattgtctatcttaaactgcatcgctaactgactacatttcacacttcatttgcttccaacatagactaaccttcttggatgtccactattatttgaacttttgagattttttttcctatttctaatatcttaaaatttcagaagacttaaagttttgcaactacagggctccatatagacatctagcttgaatttatacactttctttcattgatgtccctggactaaaaaatgttaaatatttctaaccgctgtacttaaagtccattacaaacgaagactactgttgttaagttgaataggcatcttatatatttttcaccggtgcaataaataacttctattcccttctaacatctgcttgcgttgcactgagagtacactattgattagcaataggttcgtgattacagcccttctataattaattgttaggttaacatattattcataaaatattattttattaatttttacttgatttgctactggatgcttagaaatagctatgagtatattggtagaaccagtacttatattttattacatttttacatttcataaaatttaagtgatataaaaatcctgaggaagtatgccacaaaagtggtctcagtggaaatttaaatatgttaacatttatttttaaaatgtagcgtgaaatagacaactttaaaagctcagcttaaaaaaaaaactcaaggaagctgaacttgactttttaaagcactgaagtgcaatatttaatgtaggtcaacatgtttaaatgggaaaatttttttcctaattacagccaaatccctagctgtaattaacttaaaatttgtatactatttcacaacagagtcagcatataccactttcttataaaattagaaagatctaaaattttagagcttatttggtgaaacaggcatattgctacatctttgtttataaattataatgtgcctttagagcccaataacagataacaagattttgaaaattcaggtgaattagagttatcagagggaatgttaatacactctattcaaatactatatgagtaagacatttaaaataggaaacaatactttatatattatagaaaaataatcttccagtcgatttaatccactttatgaattctctccgtatatatatatttatagtatggtattcaatttttttaattttctcatttcttaccatcttaatttggattagattgagcctagttcagaaatgacattatacaggtttatacctgttcatagtataagcacatcagttatctaaataataaaatacttgtatgattaagagaagaatttcaatctgggaaaaaagtatatgacttacctaaggaagtagtttaactacaaagtttagttctttattttatctatctataatcaagaagattttcaaaaccaagacttaattattcaaaatatcttttgatgaggctataattctttaactttggcaaggggtgtgtgtgtgtgtgtgtgtgtgtgtgtgtgtgtgtgtgtgtgtgtgtgtgtgtgtgtttaggtcaactaatgtgtttattttgtacaaaatatgaattgtatctactttctgaataatgtaacatgaataaagagggaaagaggaggtgggcaaagacaactgacataattccaaaatcttctttttaatacatcttaacgaaagatattcatcaatgagttgttctagcttcctgaatattaaaatccacctattatgtggatgatgggtgggatgcaagagcttggcaaaagaacgaagttttcattgttcataacaatagtctcatttggtaaataaaggccaagtcttcctttacgaaacaagacacattaacatcaacaactggaagcataatacaaaatcccatttataaactctctaggctttccaactgcagcagcacgcatttggctttctgtgccttcaatacattccaagggaaatttaaatgatgattgaatttgacagtaacctttttgaggttttgttttccccattaaacttgtacctctttggctcaagttccccttcaagaatgtattcacaaatgtggtgaaactagaggtaagtgacactatcactttttttagcttcatagtcatattcatagctatttttaaaactaagcaaagatctgtctttcctacaaaacaatcatttataattgctttctaaaatcttcttgaaaaacaactgagattcagcttgttgaagttaaaatatattgaagatattcacctttaagcaatcatgggtgatttttaaagcaaacttcaagtttaaaatagcagaaaaccactaactagccacaagtatatattttagtatatgaaaaaaagaaataaaaaatttctttactgctgttgattaatggttgataggttctttaatgttagtgcctttcaccctgcttataatctctcatgaaatattcttctaaagaaagcttaaaaagtctgctaaaatgttttcattcctattagatctgtcgccctacctcttttttctgtctgacagctgtttgcagacctcctgccaccgcagattcaggcttcccaatttttcctgtagaatactggcatctgtttttgaggattgctgaattatttcttccccagttgcattcaatgttctgacaacagtttgccgctgcccaatgccatcctggagttcctgtaagataccaaaaaggcaaaacaaaaatgaagccccatgtctttttatttgagaaaagattaaacagtgtgctaccacatgcagttgtactggcaaagaaagaaatacaaaagctccatgtgaaaatttccctatgaaactgacatgcccatatccaaaggatacaagacagaaagacaccttttatgtgtcagggaaaaaagcaccctctcggttagctccagtttttatttttgtaagcttgtcagctagaggatgttataatgtcctacaaatcaattagttggaaaccttttcaagagcaaattcgatttcttgtccccacaaggatgttccatgtttaatagtctatgaaatgttgtaaaatttaaacatgaacaaagtatttgggtttcttagtgatcgtggatacgagaggtgaaaaagaacaaacataggttagtcacagtattaaaaaaaaactctagagatatttaaataaaattaattgctatattagaagaaaattcatttcaaattctgtctgcgtcaatgtattttgcattagaagccacaaaaaactgagaattaattgctttcaggagcatcccatcaagatatccctaagctacagtaataaattttaaaataatctatagtcaccagagcatttttatgattgtcaagcttaaatattgtttacttttttcctgaatgaaattttaagagtaaagtatcagaaaaatagctcaattgaaaaggagaatattacaaccaagtacacacaaaaacaaaaatgctttttaccattaaataaaaatggcaattacgttctatttaactttttaaaaaagataatctagaatttgtaaggccattaaaataacatattaactaaatacgaaccttagaaaatgaaataatatctgagaacttgaggtacctaccgtatttaaatctgaatgactcaaatccttatgtcactgacagaataatgtgcgtatgtagaaaactctcctaatagatgtgattcatattctctaatatttttgtattctcctactccttgacacaatagcaagctgacagtagaccccagtacatgcttcctaaatgaaggaaggaatgcatgttttctgagactgaggtaaagctcccttagactctcgtttcacatacatttcttggcttttttctttttctacattcaagcaaaattattttcgaatactggaaattttggtagcatacagttagcaattaaaatactctgtaaatcagcaaaccggtgacacggtgcctcacaatgaatataaaactatgcacagttactgaactattcacaagctgtcctggccatactctcttgaatgcccatgagatgtgctctagtaaacatgtgatatttccttgtaactagttggctttgctccattgcttacatctcactctttaccacctgttcagatcagcgttgcatgtgacagtcattgcttagtaatagagacaccagtcataacaaactgtgtctatatattaggttggtgcaaaagtaatcacggtttatgccattacttttatatcataaattctttgaggtcagatattgtgtcttattcatgatagtttcctattgtttagtacaatgtctgatgcatggaaggtttcagtaagcatttgctgagtgaacgcatgaatctatgaataagggaagtggggaagaagcggagggaggaagagaggaaggaatggaggaagaaaagaagggaggaaaggagagaggtagaaagaaaggaagggaggaagttcaggctcatcatcaccatggagtcattagtattaatacccattactgatcctcctagagattcaaataaataagcacaattttctaggtcttaggcagtacataatctagttgaaaaaataagacacagttgcaagtgataatttgttatactacatacagtaggataaaaaaaaagcaaggtgatcaacaaatggtaggccagaagagggatgatctcagtgaaaaggatgagcggaggagacttctgggtcaatttggaatttaaagaatcgtagaacttaggcatatggagggttagaggcagtgagagtacggcagaagttaaagcctgtggtgtgcaatctccatgatgtgaccaagagcataaaactgggctctatgccactgtatgagagcaggcgttaggggaggagtacagccctcggtgtatattggggcctgggcagagaacttgaggcaacgtaaattattaaggcaacatgaactattacatgagaatcaccattgttttggaataaactgcatcgtgcaagcatcagtgactactgaaatgggaaaaaaattttgcctaaaacatagatgtcagggaggtatttagagagtaaagaccatggctcttatttgttccttcaagagtgtccaatacttacaactattacttcatacttttaaaaaatgcatgggcacacatcagatgtataccatagcggtgcttcctagactttaatgcgcatacaaatctcctggagatcttactaaactgcaagttctgctgcattaggtccgtggaggcaccaaaattctgcatttcctacaaacttcaaaaaaatgccaatactgctggtccaggaatacctctttgagttgtaaggtaatggagtaaatgccttttgagtctttgttaagcaatcaaggaattcttattgctgcttataatgctataaactaatgctgcagcatttttatctcagcctctttgctttgtagttttgatcttggcacttttgcttcatggctgatggctacggtgacttttacaacctaattgtggaatcagcaatggttttattatttcggtttcccaaataagagatagaattgaacagctaagagtgaagcaataatttaaaattgttagatctaaatctcatttgtatagaatcgcaaatcagggctttcaggtttttttaattttgtgaaagaagagctcattacacagtctactgcatttgtatgagaaggttttgcaaccaggagaaatatttacagtgcatggcctgctcaaggagagttttcagtgataaagcataagaaagaaaaataagggatcaaaacagaaagtagtagcttgtatgtggtgttttctgagctggaaaagataacactgggtttacaaaattaaatgtaaaatctcaatcaactttattcacacagtgaacaacattaattaattttaattctatagcttctaaatattttaagtactgaattattcattaccaataaaatttccaagctttgatatcatattaatgtactgctgtcataggcattcttatctatttctctggcaattaacatctagtcttggttctggacaaaaagaaaatcataattaaatctgttggattattcatcatagttagaaagcttattgtgttttgattccaatattaagcattcattcttaataagaagtgcatatctaactcccgtggggagcttttcaaaatataaaagcccagaattccattctaagtctactgaatcagaatttctggggacaaaggtatatgaaagagatacactaaaaaagaaaggggaggttacaaacatgtgcagagagttgggaagcaggaaggacatgtagaattactatattattttcaacttctcttctgctttttaagtcaaaagctgttcctaaattatagaaaataacactgttacatatctaagtccttcaagtctggtcaaattgggggaaggaaagaggaaacataggcaaagaaagaactgctacatttttatttttatacagggaaggatataagaaaaagaaaccactaccttttctatgaaaacattacgtacatttttttaaaagtctatttgtaaaactttccaaaactgcatgaaaacacaatagatgaaaaatagaatgtgacaaatgaagaaaaggaataagctaagaagcagttataagaaattgtacaatgacagattggatgaattatgtaggaaataaaaaattggcaaaaaatcacaaactagggagcaagataaaaaaacagaagagataaaatgcaactggaagaaaagataaatacagggaaatagagggaagaaaaaggaaacttcattgaacaaggagatgtttcaagaatccaatactgagatttacttgtaattttgttcatgaattattttgagacaggtaaatcattaaccgagtttactgattggtcaagagaaaagatgtaataaaatgaaatttgggagagttgtgaaacagacttttatggtgcaatttcctacaaatatggtgctttatcttgtttttttatcctaaggtcattctcattgtgtctcttcgtcagtgccaagaattcaggagtttgatatacagtttctgatacttttttcaatgataaataaagcaagttaaccagtcatgctaattattagaaaatatagccaatactgttttcagagattttaatgtgcttcagcaagtttctttcaacttctatcggatgatggatttttgtaaagaagcaaaataaatgcacaaatactcaaggcatatgctaagcacagcaccaggacccattcaacttagcctgtccatagactgagggattccgtcttggtggaaggtctgataaccttgtgggagcacctgaggatagtcagaacaattgaaagatggctaaaattggggaaatctagcagttaggaaaatggagagaagggcaaaatagtatagaaaaaaaaaagagtggaaaaatagtatagaaaagcaactaggaaggataagaaaacagtgaaaaatggctgaaataaatggcctttttttgagtaaagaaagaatgaaagttataggaggtaagaatcaaggtcaaggagagctcagaatgagaaggacaagaatccagtccatatatgaagtataagataatatccaaacatgttagtacaacagggagcatggaaaggaccatcctcctcttctccccactgccttctcggctccgtctcctgccgcttctcctcctcactttcaagcttagctccaatgcccagtaaaactgagtaactttctacttccttgacgatactgttaagttgtataggacaaattcgttactcatctttaatagttagcataaaagtaccctctttctagaggacttttaagaggcctaggggaactaagtgcccctcctttgtataggtatttataaaatgtttccatttgtgtcattctcatatgttttggactttacagctgaatattaagcatgaccgaatgagggctttcttctcttgaacagaaaatacatctctaaatttgaacggcactacagattcaacttttaactaaggacctccagatcttttattagtaatttgcaaggaactcagtcaaataaaaaggtcctgtcttgtgctattcacaatagcaaagacatggaatccatctagttgtgaaacaatggtagattggataaagaaaatgtggtacatatacaccatgaaatactacatagtcataaaaagaatgaaatcatgtcctttgcggaagcacggatgcagttggaggccataatcataagcaaattaacgcaggaacaggaaaaacaaacactatatgttctcacttataagtgggagctaaacatagagcatatatggacgtaaatatgcgaacaacagataccgcggactagtagatgtgggaaggagggagggtgcgcattggttgaaaaactactcatcaggtaggtactatgctcactgtttgggtgatgagatctgtaccccaaacctcagcatcatgcgctattcccctgtgacaagcctgtacatgtaccctctgtatataaaataaaatttgattattttaaaaaggagcagtctttacaatgaacgatcagaaataaaatgcacctttttagcctcttctttctcctgttatctttttttttttcaatttcagtaaacatttattgtaccttactaatacaaatgctgaaaccatacaaatgtgtgtgttcatttgttacaggaactagagtcaggagcaggccttgttagatttcatttaatactctctttttcctgtgaggtataatagtagatatgctcttggtacaatttcccatctgctcctgataatggttgctataaaagaataatgagaattccttctaaaactagaaatagactgtttattttccaaagcaaacatcctgccaatgaactgaaggaaaattatgtacagtagcaatttattttaatgggacatttacctaatatcaaattgtaatgaaatttccttttgatgtatttatcttattcatatcaattatatatatatatatagatttgttattatcactgctattaatgtgtataccaaaattaattcatcataaagagctttaagtactacatgttttgtaagggtatcttgggttgtttttctttctcttccaagaaatgctgccctgggccaaaaagaaaaaatcacgtgctcctcaatttcaagcagagattcaatacagtgttacctaaagtgaggaaaatataaatatgttaagtttttgccctctgaaactgagggctacattttaaatctggtcccagacatgttttggcgttagaactttgtttgattaatgatttgaatgcctttaggtggggcatgaaagcattcaatcattctgtaaaggcatttgaattggtggctcttgttttaaagaaaactgttgttacaaagtacagaacagaactttgcaaagcgaataggttttagtttgctaaaataaatgttagctctctctacgttcaaggatttatttaatccttctcgccttctaactcattcatgagaacttcaggacaaatagaaaacatttaagggctgtgtttttctctccatttacttagatttgcaaagaaaacaaattggcctttccctgataaaaaggcatcttgtccacagctgtacttgttttcttattaagtgatcctggttatagaacatgtgacttcaggcataaaattctttctacatgattactagcatgcctctgaacacattaaatgtttcatcgtggaacatattgcacgtaactcaaaaaacactgtctcaggacgtgatattcgaaaggaagcataggtcattttaaaatttctaatttctcttctctctagaggtattatcaatttggagccacataaatacttcttcaaaagccatttggcgggtagagggtgatacaatatgtatgtgtgcatatagaaaaagccaacaaaattgtttttcaaaaataagacaatgtgcaagtcaacttgattatacactgtaaatatttgatggaagtatctaatgtcattggttctaaaaccctgtagttctctactggtatttgccatgcctatattttcactctgtaagtcaattattgattggatacctcctattagccagacactgtggaaggtgctagtcatcattctctgctggaggatgaatggattggaggagcccgggaatagaagtaaggagaccaagcaggagatatcatggtagttaaagtgaggaaagatggtcgcttggattgaggaggagtcagtggcagaaatggagagaagtgcatggaaccaagtggcatttggaaagtaaatacacaggacttaatgcattggagacagaaatgaaggagagagtatcaatcagacagttgaagatactggtctggaactcagaggaaatattaggactgaaaatataactgagagcattattggcagagctatgtctaaaatttatgatgtgagttttgctccaaatgtgtttgagtcccttatttttattgaaacgattctgggcaaactcaaagctagcaatcataatccaaacatattttgggaatccctgagtatctgcatgatgactaattttgtcattattgacatttgctacatctaatatgtattattttcatttgctggcagagagattaatatcataattagcataatgtagaaaattgagaggccgtatgattccccacaaatttgaagaaaatagaatatcgttttgatgaagctgcttgtgttttcctaccctaactcccacccacctattagttaaaaaaaatggtcaaaggtgatttcaaaatatgttttgagaaagtgttgtgctttaagagaacagaattaagcttgttccttaatacacttctattctgtgttcacaagaattccatgggcctttgctgtggcatagtctttaaatgctgtctaatgtaggtaaattgttcaatgcagtaagtgttctctttagtgtgactgactccaacaaatatttaatttagggtaactactaggtgtctcaagttttacaatgataaataagcttgtattttcttgtcaacactctcaacttaatggggacaccctagaaaatgctgtgttacaatataactatggcgattgctttgagaacaagatagatcaatgaatttggcgaaatggtaaggaaaagaaacagacaagttgaggtaattactattataaaggccttaaagacagtcttttccccatttcctatatcaccaagtacagcgctgagcactgctcagcttaataattgcttaagaaatatttgttgataaattgagcagaaaactaagcaagatattataatcttcttgattgctttctcattctggaaagggtcaaaagtaactttttgaaatacatacaacagcctagagtgaaaaagagacatttaaaaataattgtgtttttatcaaagtttcatctcctaccacaaataacaagttattaaggaaagctgtcgtttctcaggctcttgagaatgggaaggcctagaaatacgataaagagggatcaaagcagatctctgtgtctaacatcaattaattgattttgagcatttagcttagattacagaacccccaagacatcaactaacaatccacatctaagcacatgttgggcatcactaagccttatatgtccctcttgccaagttatacaggcattaaacacaaattactcttttatttttccccaagccttaagttctgaggttaggtttcttgttttccaactcattatctgttgtatggtaatactactctccttcatggaattagatgagaagaggtgatgataaaaacaattgtgcctctcttgttgactgggcacgccctctgcaaatcaaaaaaaaaaaaaaaaaagaatgcacaagcatggattcactccccattatcagtacattgtacaatatcaatgatctgtattttattgaacaatatataagccagaggaacctaaggataaagcagacaaatgacataagcaagtcatctgttagatttttctcaattattcatgtgaatatctaaaaggttagggatatttgtaaaagagtggtgaaaactataggttttactttcttatcaatttagcttgtatgaaggaaaagattaaattatcaaatgtaaatcttttctaatttttttctctctaggaacgcttccttcttaggctaccacgtagcatttcaggaccttttcatttgactgaaacctcaaaggaaatattttcaagccaacatccacttcactcctaaaactggtttcttatattcattacattatttatttgaatgacatctgtattttccagtatggataccagcagttcaactttgttttgtccctttttttttcattcctccaatccaaattctattttactgatcctaattgttatacttcttgcccggttgattccatcgttattgcttttcctccagcctggttattcattacacttcacctatgttattaatacaccctcctaactgtttcatctcagactctttcactgcataacattctacacaatctttccagattaatcctccagatgcatagttcttctggtggattccctgctcaaaaatttatactgaatactcagtgcctgcctgttgaagcccaaatagcgtacataacattcagaacctcatagcatccctgagagatacctttttaggcttcttacaatgactttccaattcttcatccatgcttcagtgcaattagacaactcacagtgacgtcctggtcattctccagacctttgactattctccatcctccatcatgtgtgtctttacctctacttatgtaatcctttcattccagttgactagaccatgagatccatgagagcaggaactgtaatcttttctcactctagtgcctagtaacgtgttgctacctggcagtgctcaaaacatgtttgttaaatggataaaggtgtgccccaaatactaactctattgtgaatacattttcaagcaaaagttatctatcctataaattgggaatacattttcaagcaaaagttatctatcctataaaatcatactgtacttgaactgtatctacataatggtttttcacagtctataaaaattaaattttgttattattagagacaaggactcattctgtcatgcaagtttgagtgcagtggtacaatcatagctcactgtagtctccaacccctgagctctggtgatcctccacctcagcctcttgagtagctgagaccaccggtgcataccaccacacccagataatttttaaaatttttttgtggagacagggtctcacttttttgctgaggctggtcttgaactcctggcctcaaacaatcctcccaccttagccttccaaagtgctaggatcataggcatgagccaccatgcccagcctaaatttcattattttgattgaaaatttatgattgtctttatttcagggacattgtcttctttacctttgaggtctccactatgctcatcagttaatttgttctttttactaaatggctaaatgagtgactgagtttcttttactggtatgtggtgaaactgcagaatttttatgcacgttgaaagaatctctaagagcatagcacatttggtaaaaagcatgattaaattctatttctgtacttttaaatacctactaggggtctagcaaaaaaaaaaaatagtgctgatgctgaagctggtcaaagacaattcaaatgttctgcacttcatattagtggtggggttgccaaggaacagagcttttacaaagctaatgccctgctgctcaggcagcaacactgcattctagtagactcttcagataaagtaaaaagaaaagaaacaaaacaggaaaatgtctgtcattcccagtcttcaagttatatgaatgacctcaaaatgatactattttcacccaataatcataaaggtaataatcttcaacacacataatctatatgaatgtccaataaatccatgaaaagatgcttaatagtgctagtaatcagaggaatataagttaaaaccacaacaatatacctacatattctgtaagatagcaaaaattaaaatgactgacaagaccaaatattgacaaagatgtagagtaactggaactctccatcatcactggtggcattgcaaaatggcacaaccactttagaaaactgtttaggtgctgtttgacaatatctcataaatttaaacatttcacccagccattccacttctacagagttactcaaactaaatgaaaacatatgctcacaaatggcttgtacacaaatgtccacagcatcttattcataacagccaaaaactgaaaaccacctgaatgtccatcaaaaggagaatagataaataaattgtggtatatctatacaatagaatattaatcatcaataaaggaatgaacagctgatacacttacatggatgaatctcaaaagtagtatgctgatcaaaatagtacattttgtatgatttcatttatacaaatttttaaaaagacaaaactaatctatggtgatataaatcagaagaataggtgcctattggggctgggaattgactggaaggtagcatgaaaaagctttctgaggtaatggaaatttttattttattgaggtgtcactttatcagtgggaccacttcacaaaagttaacagattgagcatttaatatctttactaacttatacacctgccacagtataagttactgtcacacccagtaagaaagcgtggaaaatatattagatggcagaatctgaatattatacaaagtatcttgacagattgaagttctcaactaaatatgacaggttgaaatgttatgtaagaacaaactcttcctcctctcccaaataagtctgtttcatcttatataaaattttacctcaattaagaaataaaaacaatatcatttttaactgctctccttacttacacaataccttagccatgctaacaatcagggcatccagcaaatctaagtactttctctctcttacttcacacagtacatatggacccttcttatgcaagaaaacaactaactgaaataggctgattgccaaacctcagtcatttgcagacagaatttaaaagagttcagaagactaatcaggttatacaggaacagacttcgtgaaccatcagggatattatacaattcacccttttatccccacacacaatgatcaatttagacaatctataagacgagtcaagtggcatctgtctttcaggaacacacgtgtgtatgtgggggtgtatgtttattagattaagaaggaaaaagcgtagagattcaacgatcttgaatttcaagagaaaatggctcaagaaagcctgtaaaagctctttagaataaaattttgacaatataatggcaaatcatcccagtgagtataaaacaaagatgtgtgccactgtatggacaacctcaaaggtgctcagattctaatagagtatgaacatgggaagaaacgagggacagagaactgagggcaaatattagaagaacaatatagaactgtataaacagtgaggaaaagctgagcttggaatgaattgaggctcgtgataatggtaaagacaacattcagggcctttttacttccatttggaggaagaagaaccagaaagacgaaggttcactgattggggcagaagggagaaggttagggatagagacgacacagaaagcagcagtgtgcagctccttttgcttgtctgctctgtcaaggagaatgttcatcagactggaaaaggcataaccgtataagggaaatgaagcccaaaataggtgagggaattttaaaagagcaccttgctgctctaaatgagctaaaatctctggccctggaccaattatattctagggaaatgagagaacttgcgcaatacagtcctaccccactgtcagtggtctttgaggaactatgttaacactgcagatgggcaaatgtcatctcgatttttaaagacaggaagaggtcactgcgactgtgttccatcaattcctgctaaagagcatttctgaatgatggaacaaggagcaaacaaacacttgttaacaaagacaacgtggaggcagctaatttgggtttgtatgacaactcgttcttacaccagacatgtgtgcctgtgtttgcagttgaatctcttttgcagtatgaaaattgaatttcacatttctaaacaacttaaaaaccacttctttttttttccagctaatgaaagttaaattttcttaaaatgaaataaccatataaataatgaattgtgttctgttgtacaaggagcagcatgacatccagttgcccaccacctgaaaaagtttgaggtcctctggcaaataatggacagagacaatgatcttatacgtgcaccattttgtgttatttgacatggtgacaatgggtctcctttctacaagaacagaacaagaggaaataagattgcagagtagttggggaacctacacaggagggagtcttccgaaaagagatttagactgtatcaatatccagaaaaatgtcgaaggtgatttttggaaaatggcatcattgtttacatttattcttttggttttcttctatcacttttagtggatttttataatgaagagacatacgtttatgatcagaaaaaaataaccctctacccatttgggaaataaattgatataatcttaccaaaacaaggtatttttttctggatttttttattcaagagtgagagaatagataaaatagtctttcccagtactgtatattaattatttaaatatgatattttaaaataaagttatcatactttatctactatggtatcagcacctgtagacataatttactaccatatttgcattagtacatattactaaagtttttcagagatatggccatatatagtgggtaaaagataccaaaaatcataaataacattttattctttctcaagtaacattattcagctcctctaatataatttcagagcttttgttaatggtatttttctacatactagttttgaataaattcatgtctaccatgaactatctagggagaaatgttgttaaaaatgctgttacaagttccataaacttagtttacttgatatcttataaacatgctgccttttgcaaaatacagattactactgaaatcaggaaagcttagaattattaagacagacgtattgtagggaaataagggaaaattgctctaattttgttctgacattcagaatataaagataataggtattatcatgatgtcaacatgctccatcaaaactcccattcaataccattctttttccatatatacttactttttttttcctcatccttggccttaatacaaaactcaatatttcatttatagtttgaaattttgttacatactaccctaatcctatgtggattgaagaagggtataaatcaataaaacttaaaactgaattttctcctttaagcagtttagatattttaattagtaaacacaaacaaataaggttagctatgtattgcacatttaaagaaatatcacactgtcaatgtgaaaagaaatttgtaaggaaaaaaaagaacaaagatcagtctgggacatctgcaatacattccagattcaggaacaacaagttaagtatctacctactcatcttttctggcatgatcttctgttaaaacaaggaaaggcagttaccatacagaaatgttgattttgtcagacagataaagacatcactaatactatgccaaagaataattgcaattatcttattgtgataatttattgctttcatatacttcataaagtgctatcagatgattgttccatttgagatccacgtgaagtatgaggtcagaaaaatgtgttattattcctagggtaaagacgaggaattgggggtctaaatatttgtccaagttgtcctgcagataaaggtcccaggaccaggccccagattgttatcacatttcagtgagattcccattattcggtactggctcttttctgactcaaatacttagatattaaagagatatatgcgagacatgaaaagtagaaagtacaaaaaaatcggcaagttgtacacttttaaattattgtgaaaataattaaccaaatacttcataattatagatgtttttggtagaaaaaagatgattcgatactcactttcctattaaacatctattttgtctttcactttgataatgctgttatcttcagttaaatataatcattatgtgaataaacaatgtggatcaaaaaagaatgagaaatatcaacccagaatatgtttgaagctgatttaaagaggacaacagcatccctagattagattacatgtttttgtaaagctgctatattagaatgtcatgctgacatgattcttgataatgtatttaatgggtaaagtatgcatagtgaacatttgtgtagagttcatcacatctaattttctgttttcttttgatacacgaaggtgaatgatgcaattgtggtatttctgctgttgaacttaatgaaaattctgtccactatcaatcaaatagatcttttctcttgtttgttgtccaaacaaatatgttcaaaagtaattcatttttattgaaaagtcttgtactcacatgatgaaaaaaacacaaacaaggctttaatttatttcacatgcacttgcttgcaagctatacactggagaagaggggaagtttagttttatatttatgtaattcaagttatgtagatagaccaggtgttatataaatggacagatttttaaactagtatgtttcaataaataatatgagccaatcttcagaaatgaatataaacatgtggcatccttctctataaaaacacaaggttgaatggggctcatctgaagtgttgctgcaacagtgtgatgtctgtcctggccgagagtatgtgggatgatttatctcaatatgtttttgcagtaacaggtcatactgaaacaatgatgggacaacaaatcacaatgtatgccatacaaagaaatgatatgggaagaataatttcattcccaagtatttaaaattgatactctattttgaagatcaccatagaattagaaacaatgtaaaagaatagacctggtaataataactataatttctttcaaaaagagaattcataaacatagaaaccaaggactcagagaagaaccacttataaacattagaatattaccttctgccattcctaatttagcatataaaggtaactttttaaaatctctgcttttcataactgagagccagaaacaaaacgtctgcatgatgattaggtgttctttgtatatagcaacagtatccccttgccaattttaacaatattaagaaacatatgccccactctccagaataaatagctgtgtagaagaaaatgctttgaaacattcattgtcttcttaaaatatgaaaatcaacatttaggaaaatatttatgtcgcttctacataatagcctttgggtaagtacagattaacttgacagaggtctttcacgcttaaacatcgacatttaaattttgattgacaaccaacagtaacgagtaacgctttcattttagatatttaaatatacagaagtaccatttgcctgcaagactgagcaaatgaattaatttgttcagtaaatatttattgagcgcattgcatcctgcatcagacagttcctgaccttaggcatttcattgcaggtatagacaaacaataaacaaacaaagatgtacatacacggaataaacacatattgtggtaatagggacaaaagaaaatcacgggatgctttcacagagaataatggagaataatgataacggagactaataatgctcaatagttgaggatttgcaagattatggtgtaactttagataaagtgacctggaaaggctttggagatgaagttactgaaacgggagatgcacaaagaagaacagaattaactacttatccagatggagaaaacagcatgtatgacgctcccgagtcaggaaggaactttatatgcctggatataaagaagctgaaagaaaacgagaatggttggagccccttgaatgaaggggagtgtggaatgaaatcaacttcaacatacagattcatgtacaaggatgttcactgcagtgaccaaaatgtggaagcagtcccaatgcccaataatgggagaataattaattatttacaatcacatctgggagtttactatattgtattgcattttaaaatgacatataaaatttaaaataattctaattattaaacatcaataaaatattaaataaaagatgataaaattttttttgtacaatactacttgctaatgggacagaactcaagaaaacatcaaaaggtgtaaaacccattaagaaggcaacctatgggagaaagactataggtgcttttttgtttgtttgttttgttttttttctgagacagagtctcgctctgtcaccaggctggaatacagtggtgtgatcccggctcactgcaacctctgcctcccgggttcaagcgattctcctgcctcagcctcccgagtagctgggactacaggcacacaccaccatgctcagctaatttttgtatttttagtagagacgggattcaccatgttggccaggatggtgtcgatctcttgacctcgtgatccacccaccttggcctcccgaagtgctgggattacaggcgtgagccactgtgcccagctgtcttaatttaatacttttgtgtattttcaaacttttctacactgagctttaaaaagtataagcaaaaatgaaaaacaaagtgaaaccgccatattgcctttgtcctgaaatattaaaaaacgaactaaaatgggcacagaacaaaaactataatattcctatatgcatgttcacattgagaaaaatagtgagacaaaatgtctgaatcctggtaactatgatagaaatggagtgtgcctatatgcacgtgtgtgaagggaaaggtattctctctcgattatctatatttatctatttatcatttatctgtcatctattagttatctatcagttatctatctatcatctatctgtttaccatctagctgtaggtcataaatagaagacattttaattaatatttgctattgacctattctcaaaaatcactactgaattgtttacaaaactcagcatgctttgccaaataattaagacctttatttgtattcatgagtcttaattgccaaacaattaagacctttacttgatcaaatcaagaaaattagcatatcacctcaaacatttaccatttatttggggtagaaaccttcaaaaccctctcttctagccgttttgagatacgcaataccttactgttgacaatagtctccatactatgcaacaggacaccagaactaattcttcctttctaatcgtgactttgtacccattgacaatcctctccccattctcgcttttcccctacttcccccattctttggtgaccaccgtccatttactgcttctatgagatcgatgtttttagattgtgcatatgaatgagaacaagctgcatttgtctttctgtgtttggcttagttaatacaacatatgaaaaaatgttcaacatcactatcaggaaaatgcaaatcaaaaccacaatgagatatcatctcattccagttagaatggctattatcaaaatacaaaagataaaaagtgttggcaagaatatggagaaaagggaacccttatgcactgttggtgggaatgtaaatgagtacatccattatggaggacggtatggaggttcctcgaaaacttaaaaatagaactaccatacgatacagcaattccactactggggacagagacaaagcaaataaaatcagtatgtcatagagatatctgcattcccatgtttattgcagcattattcacaatagccaagatatagaatcaacttaagtgtttaataatggatgaataaagaaaatattgcatatatatgcaatgggatattattgagtcatataaaagaataaaatcctgtcatttatgacaacatggatgaacctgaggatactatgttaagtgtctgaagttttgactcctgaaatgttataatgtcctcggtttaggatattagcttgagtagaatggcaacaaggtttgcacaaatatttaaaaagtgactcacaagaaaaagtgctatttaagccgggcatggtggctcatgcctgtaatcccagcactttgggaggccaaggtgggtggatcatgaggtcaggagatcgagaacaacctggctaacacggtgaaactccgtctctactaaaaaaatacaaaaaattacccggacgtggtggcggccgcctgtagtcccagctacttgggaggctgaggcaggagaatggcgtgaacccgggcagtggagcttgcagtgagccgagatcatgccactgcactccagcctgggcaacagagtgagactccatctcaaaaaaaaaaaaaaaaaaaaaaaaaaaggaaaagaaaaagtgctatttaaaaatagcaacactaagaataatacaatattaaattttcatagtattttaaagcctccatagcatattaatttattcaaataactttcaggacaccagaactaattcttcctttttaattgtgactttcatacattaactccatgaaaaattgaggtcaccttttataccaattttataactttgaagagtaaccagtgatatttagagaaattatattagggcactctcacactcacgttcttgtgctctcatttctctctctgtctctctctctctctctctcgaaaccagagagggagagacttattgtaataaattggctcattacgaatctggagaagtcccaagatttacagtcagcaagctggagacccaggaaagccaatgatgtagttcctgtctgagtccaaaggcatgagaaccaagaaagccaatgacgttaagttccagccccagaactggaggcttaagactcaagaagacccaaggtttcaattcaagctcaaaggcaggaaaagatgggtgttccagctttagctatcaggcaggagttccttttaatcaggctttttgattaggtcttcaatcgattggacttaggtcctcaattgattggatcagacccacccacacaagggagaacaatcggctttgctccctctactgattcaaatgtgaatctctccagaaacagcctcataaacacacccagaataatgtttgaccaaatgtctcggtaccctgcggcccagccaagttgacacatgaaattaaccatcacagaaattaagtaatttgttgaagttaaattgatagacttgagatttttaataacaatcggttccaaattctagcctgatgtgttttttccttttattatattaaatttattgcaaaatgttcttaaagcaaatttggaaaaggctagatttcttcaggtcagaaattctgccgtattcaatgcatgaagaaagctcaaatgaatctatttgacagacctggagcagttattttgtctgatgctaaggttttgatttacaagcgcaagaaaaaattgtctttgtgctttctgattgtggcagccaagttgagtggggaaaaacaggagaaaaacatgctaatacggggaaaaaaacataaagagaggatttttgcaactcagaaatgaacttatatacaatgaagagcctattttattcctaaaataataatctaaaattttattttaaaaatgagaaagcttgagaggtatttattagattatatactgatttcctttttttaatctctatttttaatgtagactcaggggtacatgtgttggtttgttacaagggtatactgcgtgatgctgaggtttgggcttctgttgattccatcacccagatagtgaacatagtacccaacaggaagttttgcagcacttgctcccctccctcccctcctcctttcggagtgcctaattcgtgttggaaatttgctttaatcttaggggaacattcatagaaaaaactgtacaaagggtttctttacgcattctcaatgatgaaaatcatgttgacattgttctgtcattagaagacatgtacaaaaatagtttttgataaactagcgcttaatgtcttcataacgtaagtggaagcgatgaaaatatactgcaagaaactatttttcaaagtcttcgacatttttactttttttcaactaaacacttcagtccttttgggtgagctctttatattatttaaaaggttcttttcctagatagtttatgtaaatgccttttcctggagtaacctttaaggcattatttggaaataacatagtttctcctaaagtatgtctgtttttatccacaacagtagagtagtaggaaagtgtgtgctaagaaagtacaatattctctttgtcactgtacattattgtagttaccatatgagctaagagactatgctagtgttaaggttgcctttatagtatgattatacctgttattttccttgctctaagtttgttggcatttcacaagaaataatacgtacaaccacaaagttaacttgagctgtgattatgagaaaatggtacaataagttaagcaacacatttaaaacaaatagttcaattactcaatttcatgcggtacagttttaacattgctagtacatcctcagattaaatatacgaaaacattaataactcacgtaagcaaggtgtaaggcagttacacatcctaccacgtgtaaagtatgctactaaatctgaattaaaataaatataagattaaactattactttctagtaggttaacactccgtgaggaaacaagatgtaagcatataaaaagtcaaataaagttttaattaatgttcaagacaatagaagacatgtcatatttcaatacctgatgaatttccaaattgattatacagacaaaatattgtagttcagagagagatcttcaaagatgacaaacaaaaggtctacaaaagaataatttatgagttttcctgaaaaccaatacaggttttgagagttgataagacatggttgatgagatgtataagaaataaaaagtgcaagaacacagggggatttatgacgcataatattgagattatattaaaacaggcattgaatatcaggaagggtgattttataccagatcttgtaaatagaggggatctactacaggttttaaggagacaaacgatatgataaatgttatttttatggctgatcacagtattataaatggattggaatggataatgtgattacaaatggaaaggaaagcaggcagaaagaccagaccagtggcaattacaacgtaaggtactatgacttttatctaagaacttggaaaaaaaagaggtactgagaaggaaaagtgtagcctgcaaaggaggagcaaaagtgggtttgaaccttaataggttggaaggaacaggaagtcaattgtggggatgactttggaggggagagcagggatgaatttgcaaagtcatatggaaactgcggtcatacggagatatccacatgtcatgtccaggtagtagggctagaaatacaggttggaacagagataaaaaacaggatagccaaagccagaagatgagatgtaaacaaaggtgaggtcagagtgagaaagagaaaacaataagcctcaactgatgattttgacacatgagaggaataaaaaactaggaatattacagaagctaaagggttacagactttaaaaaaaaaaaaaaaggaaggggaatatcgcagtggtattgaacaagataaaatggcagagaagccaatggatttggcaaatacattattgttgattttgaaagtttattctacagctatttaaggaatgcccattatgttccaagcactgttccatgttctaaagatacggcagtgagctctcatggaatttatgaaggcaacataaaataaacaactaagaaaaccgatgcatgatacaaggtgataaagaatatgaagagacttaaaacgcagtgtaaggaagtggagagtgagaacagcaggggattactatattactgtggtcactgtaatgggagctaatagacactcctgagggaagttagagggtaagacgtgtggatagctgaagaaagaaggttgaatttcagcaggaggaatcaaaaccaaatctatagagagaggatagtgaaggatttatgttggaatgacttacggttttgtgtagctagtttttcttaaagaataaactggcttatcctcttgataaggaattagtggtgaaagaagctttgaagacatttaatgttaggaagcaagaaatcagagttgtgaagagatatgttaaaattagggcattgcctccatgagcaggccattaaaactatctggaaatgttgaaaggactatgaaagcactagatgatgatgctacgtttctgaagttatccctcatcattggctccaaatatgcattgcacttaaaattttattttataatattttaaagtatatacacaaacaatttaaaatagctgcaaaaatatgatcacgtatggtccctcgtttttcttggctcactcctctcctcctccacccacaacaaaccttcctccactaaaataacctaattatttatttctgtaattttgcacttgatatttttttcaatttatatagtcatatatacttttgtagagcagagggtgagaagagatggatataaatgaaaatgaaactagaaataaattaaaattctttaccaaggtaaaaataaatcttattggtcttatgataatgcattgtcctctgtgatcaccaaaaatctacaatacaaagccagccaatctcttgggagagtgtagaaagtttagggaaatgtaattatattttatttgcagaaggaatcaatatggcggtacttttcaagttcaattcaatcacaaatgtaaagaacagatttgcatttacatctaagcagaagcgtggtggattaaaaagatttcaataacatttagtcatctctttgtcaaaatagggcattcattgaacataatgacactcaaggccatccttccaataaattaccctataaaacttccattcaaaatttaatatggtacaggttggggaatataggtaattaaatgtgtcgtagaggtagaaagaagaccctgggtaaaggaaaagatggtaattaagatttgaaagaataatactgaaataaataggttattctaggaaaatcttatcagtatgctaatcactttaggtcccttatcataggaaagaatcttaaacaggtgcttgggacaatggtggtcaaccccttagcggtttcaaatgctaggagtctcatgacacacaggctctaaaccttgattacctttctacaagaacattgttgcttgttgatctccaatctttttaatacgctaatgtcagatggaaacaaattcgactcctggatggcaagcaagctgcactgggattgggtaaggctagaagccatcatctgcaacacagagataagcgaggctgaattctctgtggccttttgagactgtattatgtgaaatgaagaatttacaagcagaaacagtagctaaaaatctcattattaatgacttttgagcagccacggtttctggtttttcatgtgaatctgtaagagacttaacaaagacaaaaatgtgggcacaaaaaatgtagcaaataaacagaatctgggactaaaatagaaaaatgtaactgtgtctcaaaagtgtttacatactggctgaaagagtgaactgtacagggtttgtttaaacaaaagttatgtaaatctttgctcagctggttgctcaggaaagtaaatggaagcaaacagaggaaaacagaccacgggctggaagagtttgtcaagaatgataacgggcattgaagcatcaggatttaaaatgatagcccagcctctgtaaataatgcaagctcttcaggatgcactagagacccaactcgacagcatgataattttagctaaaaacctgctattccctccacaagactccataaactaaagaagaaagctgagggattgtatacacccaaaacgccaactgttagaagcgtgggaaacctggcacctttaaatctctgattttatcccttagttgcccatgacattgcctgggagattttgcagcacttaaactgggataagttagacaattaaagcatctcagtttttgtctaaccatgctaaaaataagagtgacaggtctgaagcaaacattttgtgcctttgtatgcaaacaaaattcagttgacaaaacacaaagtacaatgactacgaatgagctaaagatacaaaattaagttaggcaaaattcccatgaacgctgtcccttccccgctaaatattttacttccgccactgaaaccctctaacaccaatgaaataaacataagttggtaggacaggtgagaaaaatcttcttaaggagctcaaactaataaccctacgtatcatctggaaaacagtctggcaagaggccttcttttcgcattaaccttctgtgggctccgcacctgacaaagcatggggctgctccccgagaaatgggactcccagtgacacagactaactggagaaaaattggcctgaagttatacatcagtcatttgcagaacaagacttgaggatcatcagcctttggaaatggttttattccaagttatacaggagtaggcacctgctttatatctgcccttagcactccggattaatcgcacatatatagggaaatgaatttctccctgttgatctcttcattgcaatcttgtgcccacaaaatctcaatggaactgcgctaacaggtttaaaagaccaagtcaggaaattcacttgtcacttggttctcaaagtgaacgcgaaagaaactgaagaattcaaaggggtcatggatatttcttcaaagctccaaatagttgtttggtagagatgacgaattttgagccatctgggcaatacgagaaggctcccctgattatccttccttacgtgcttatcaactcacttgcggccctagggagaggatggcatttccgaagttccaaattctctctgtgtgtatctgtgtgcttgagcgcataagttattacatttgtatttacttacttaaatatttattcatttactgaaaaagggcaagaggtagtaaagtaagtccacagagtgaaaaatgagtaggcaaatttgaaagtcaccagtgattactctattggttgaaaagatgcattatcataatgaatgcattagagataacaaacatatgtacaagtgtcaataggtttgtaggattatggctgattttattcgtcttccgtgcaacttcctatatttttcaaattctataatgagcacttattacctttataataagaaaaaagaaaatgcaaaccaaaattgaaaagttttacattttgtggataatttatggcacatctttggaaattttatgttagaggctttcactggctaatcagaaattgctttatctatttttctttgttgaatggaaagggaggagggagggagaggggaataagcaagggagaaataatagggcaaataactggttccactcaagagcaaattaactttccctcatgggtagtcagtacatgttaattgatgataattaagaaaaatgagttttcttttttgtgagcaccaccacacaattccatattttcatattagctaaaggttaaagtcaaactgatccagtacaactttgcagttggatgttaactacttttcatagaaggggccacattcatggtgaatctcaagacctcgtttatttgttaaatgcatctttgcaactattttctatttctccctataccattaatgacacccacaatagtacacaggacatttgatcactatttcttgcatgtctgcatttcctttgctgagaaatagagaaatacataaagaacaaaaaagggctctaagtcccattcaaaaatctacaaacgtgactgctgaacgccttaacaaaagcacccatgaatcggccatggctttatagctgcgaagggacaacacataggcatggagagaaattggaaaaaaagaaaataacgtgaattagaattctgccaatagtattagtgctaatgtaatcaacatgacataagtatgaatctttgaaataccaaaacttcgagtaggtaaagtggttctcaacaatatctttcttctcagggtaatcatagtgaatatgaggatacatcgacagggaaaagaacagtaggtaatttgagggaattttgcagcactaatttagtctccaaacactgattattcagtggtcattattccaaactgcgagggacagtaatgaatccaaacactattcgaaaggcaaactattacagagaatgttacacccttcctaagttgtgagtggcacagatttatgtaatggcaactgggaacaaaaacagccaaggtcagtggaaacctaattgtagtactttatctagttgaataaaaatccacatttttttagcactgaattttcagtaattgaaaacaaaaaaagtggggcttcaattttatatcagctatgataaaagacagtaactcaaaggcttgataccttaaacttcagggttgtttcctgttcattgtaatatcctcagccttacgtagcgttgcaggcatataaccggtccaaaacaataaaaaccatgttgaattaattagtgagtgagtgaacaatgaatgtagaagtagataataagccaggataataagtgatgaactgtgtcagaaccaagatcaacaacaagaaaccaccaacctaactacaccaatgcaatgatgtcatctatgggaagggaagaggaaagggcagtatgctttcatgaatattaatcatttataacgtgtaaactgtatatcttccattccacaatgtgggttcagctcttttcaattaagctttttctttttgcccatataatgatccaatcagaagaaccttagtcaagtgctgctgcaaagaggtgcctgaactgggtgaaccctaaagaaaattctgctgcctgcattggcaagaatccacaagccactctgtatactgcatcttatgtgaatcttctatcatttgtatattcaatcttgaataaatcaatttgccctcttgggtcttatgatcttcgtctataaaatcaggataggtgattgctaggttctgcataatatgaggtttaccttaaggcaacctaggtggcacactagaatcactagggaagctttaaaaaaattcctattctcaggtctcgcaccagaaaaatcaaatcagaatttctgcaggtgggaactaggcatctctatttttttttgttttttgtttttttagagcttccagagtaattccaacttgtagctaagattgaaaactaactctttaaacactaattgttgtcacctgagtaaattaaggatactttcagagccataaaataatttactttttgtacttttttaggcctaaagttatatatttctagaataaagatttgtgcacgtatttttaaagggcatgtggcttgtatttttttttctttgcaacttaatgtgatgattaatattccaaatttgctaccagttttcattattactcagtattttcaggcatggatggctccatagttcaggatttctgcctatttaaaagcagtcgccttaagcacattttcgtctgtcagtagatgtatattcttcctgcttttaataatgaaaatttcattttaagtgataatccctaaaaaggatttcctggcagaatggtttatatcataagagcgtatgggagttaagaataattatgcagcgagtatctttctccaaagagcttaaagcactttatggaattcatctaattaatgttcacactatatccatgagaaggcagtggacagtgaagcatggctgggtctgaagtgagctcccattccatgccttgagagggtaagattaaacccagcaaacgcagagttagtgtagtctaccactgtttgtcagcccatgacaaaaactacattttatcacattaaaataaagaggaagaaacgtataaatcagctgagtttctttaccctttggatttcaagtatcctaacagttaaaaacacaaaaactatcagttcctttaacaattccagatgctctggcattttagaaatacggtcaaagtttgattaaaatgtggagcttccctagtagaacaaacaatatttacactgcttttcattcacacaataaatggtaagcattgtcagtatgtgtgggcatatttacatcaactcaaatgttacccagatctgactgtgtacttttagcccagacggcctgacagatgaagttaattttaatattatctcaagaaaagcattaattatatgcatgcctgttaatacgttctggtggagaaaaagatagaaggatgggagtacataatagttagaaaggctgatttgtaaacaaaaataaaaacaacacttcagtacctcttccctattttaaatcacagtccacagttcagcttttccactgggatcacgtcgtaacctgacctgatttccctaacctggtcagattttcttcagaataaaattaataaaagaattcacagaaggcttacaatttcattaaaatagataaaatagttccaacttcataaaaattgtattggcacattcaaagacataaaagaatacttataaattctacaatgcataatctgtgaaatctttttatttgaaaaacaaagtatttagcaaatagcactgtctctccacatagtcacaccatgctgacagaagataaacataaggtcagtaggtcttcctcaaagacatccatccatacactggagacatgatcaattcatctcatcactttcatagtaggggaataactagcggatactttttgcctaaaagcagatttgactctgatgattatcagtacaaatttaaaacgtcaagtcaatttggagaagtgcaagcaaaggcaccaacaaatcaatagtaagattctttgatgttcatcttttaagattctcctttgtactaactcttgactcatactttcccatttaaagtaactgtttattaattgaacattgaattacttgaaatttataataccagctaataactggataagctcttaagggtgtttccttacctgtacccaacgtacagttgaaaattgtggattatttcacgggaaatttatcctgactgaaattgatagcaatgccatacgaaactttcatgaaatttaaatacatagcattgcataaaattaaagcaaaataataccatttgaatttagttttagccttttgagtttggctaatcttaatcactggatgaccactggcttcaacatagaagaaccatataaaaggaaaagtgtacaaattattttaaagtaaatgactgataatttcttacatatcttataaggactattaccttactgttgttgactctacctttctagacatgcctagggactaattggattactttgaaacaatctcttttactgcaaaaggaaagaatttacaaaggcaaagctctatagccaatgagttaagaagttacttactgaattccagagggtgttccatattatactgtggtagtgaacgtggcagtggttgaagtgggttcttagtggatgaaaagtggttctgaagtcgtttagggatcatatgggctaaaattaccatgatagcttcattagcaacaccacctgaagtagaaactgtctctgtataatttcactcagaaccaagttacttttcaactggtctctccccaggatgtgttcctattagctgcaaattcttacaacaaccttatggctaatgaggattcagaatccagaaatggagaatttgttcctctgaagaaagttagaattttaaataaatactgcaacttctggagacttctcaatttaatgtgactccatagtgatcatagtgaccacatgggtgaaacctcttcaaattgataaataaaatggaatttccaattgtgtatcttggacaatccatgcacaattagaaacagatgtaacaatggctttagatgcatgacggataaactataagggccacagttgcatagtactctgactctataagtgtacattttaaacaccttcaatgccttctaaaacataagaacaaaaattgttctggtaactttgatgacttctacttaatcgttgtctttctcagaacaaataggttgaacataaatgcaatgctgtttgataattttgttaaaatgttcaaataaaaaacagtgatttattaggtcccatcgaaaattgcctatttatgtatacaataagcatgagaaatccaaaggaaagcttcatgaaattaccttaaatgctagtttttaacctcctttgaatgagccaatgtgtgttcccttgagaaggaaactttctcaggtctgtgactatttaaaggatttatttttctattgtaagttttcttttcacataacaccagtgaccctggtgatagtaaagctttagcacttggttaaactcctgcgttataatgtatcatattatcatattgtatagaagctgtactttccagtgggatagtcattagccacatgtggctatataaatttaaattaattgaaattaaataaagttaaaacttcagttcttcattcccactaagcacatttcaagttctcaatggccacattatactgcatttctaacattgaagaatgttctataagataggggtgatagagagacggcttctttgtctatctctgccactagtttatccctggtgaggagggcaggggttgagcataatgggttgcatacaacgggcacatataagtgctcaaaaatacagtgaaccaatgaataaatcttgttattattaccactgacactgccatacattaaatacctttcagattaaaagtgcttttacctatcagtggtttccaggggctggggtggggcaggagactgactgcaacgggagtacaaggaaactttttgaagtgataaaaatatttcctattctgatcacggacgtggttgtaggactgcatatgtttgtcaaaactcatcaaactgtacactttaaaaaggcgatttttttgtgcatgtaaattatacctcaataaaacaaaaaggaattggaaagagagaaagtaggcacttttatttgcattttaaaatttcatccttgacttttagagtgactaaaccagatgattactaccgagaaacaacaataaaaatatttagaaatgtaggatgcatcaagtgtgctttggatgtcaagcaacttaggggcacagatttctaaaattgtcttgggttaacatactgctcagggaagacgctagcgggtctcactgggaagacctctcccctccaatctcacccccaccccactgattctctaatcacttttgattttaccatctgttcctcctggcacaacaaaggttcagcaagaaaagtgacagcttcaacaaccttgtcttcaatgatatttttgaaattattggaggtaaaaatcaaatcggtcgatttaatccactatttattgagtgcctattcatgaagtataaattcatggctataccagtctgacatgatttcactaatattatatgaatctaaaacagtggccggaaaaacgtgtgaccaattctgatttccacattgcacaaaagttgacagtgatgcactgactgttctgagaaactttgagggttaactaggaattaggatcatgatttcttgatcacattccctggaaagtaaaccttgtgatagaatatgccaagcaatttggtatgtgcaaagaaatgtaagatttctgtaagccgttcctttctgggtgcagcaggaacttgattggggatttccattagaaaaatctcctgctcatcatgatggtcaaagcctgacccagcttgttaatcttcagagcagaatgcaacgcacaactgtttgcactatccttttactttcacaaattccagtcgctgttgcctctatggtgtcttttaattcaatgtcattacttcgtgtttgttctctatggtgatgtttattacaaagagcacaaagggaacaatttatgcactaaaggtatgtctctgcttatcagaataaattacccgtataagtgtctgcaaaaataatcccatctacttttcttggtgaatattgagtaaaccgttaacagggcagtgaagcatttgattatcttctcaagagaatgaagaccttcatggtcatcctccttctaggactgagagaaatgctaatttctcctcaccaaggttatgaaggtagcatatcatctttacacctagcattagctaagtttctcaatctcaaaattgaagaagtgtttcagtttgttaagcccatgatgaaagcttgtctttttctctcacattctagtctataagtagcacagctatgtctggggtcttagtttttttttagaataaggatgatagctctgtctgtcttcgatgagggcctgagctctaggcctctggatagaaacagaagaggtaatctgtcctacatgtgaattaatgtgaggaaggaatgagaaagcagatataaagtacctagtcactatgatcataatatacaatttataagtgagagctccgatatcagtaatattgttactagtataactcgctgtctttcaactggtttattcatttagctttctccatatatatggtaagccccaaagcatttttttgttctcctctttctcaagcctttctggtcctatggaaagtgttggagtttattgctacagaaattatttctttagtttattgtgatccatagtttggaagttaagtctatttttatagctgtttttctccttcagagcatattttcaatttaacttagcaaacaggcactgtttttaattccaaaacaaagtaatgcataaacaaaaactctaaccccaagaggttcttgatttagctctgctactgtgtatcctcaaccagatagttaaatttaagaaatggaacttaatgtctttgtctgctaggtgaagcagttgaactgcatgacacctaatgtctctgccatctctaatgctactgtttactattcagtgattttagttagccaaataacaaagtttttaagcaattttagcaccctaggcaaatacacccacagagtgaggattttggcaaactattttaatgttacaatggacagtgctggaaaatacgggctcctcaaaacaaaatcttaccttgcctattttagacccagctttttgagagcaaacaatcaagttttgtttttgttagtttcttctcaagacttatcccagggcttttcttataataagtgggtggtaaataattgctgaataaattatggggactcttagagctataaaagatagaatttgggattacctgtgttgcttattagaaaagtttttaaattaactaaatcattttgtgaggatatatatgaactcagttggcctcacatttgccttgaagttttatgttcctgcacttaaatcaacagtgctttttctcattattttcatttcttcagacttttttcccctaacatagttgataaaattccttctgcccacactgaatctttaaaaacacagagtagttggaaaaaacttgtgttttgctatatgtgtataattagtattctgtataaagaaatgaccgtagttctcttgaatccagatgctgcgtgggggttaaattttacagattcagccatttgctaagaaaaataaggtcaaaattttagggtaagaaaataatgagaatgatttaaacttgtatagtacatttcagtttataaatttctttctaaaagtttctttctaatatagtattttatttaattttgacaacaaaactgtgatgtggataggtgtgccactttatagaaaaaagctaaacaaactaagattcaggaagctaagtaacttatttaaggtcacacacctagtttttggcagagacatatgttctggcttcaagttcaaaatcctttccactatactacaattacccctactttacatctaaaaacacttcctagaaatgcgtaagataaaggtagtttttgttttattcctaaaatagattaatcatgtatatcagagatattacaagttgagaattagcaggatgaaattttgacagaaccaacaagatgcaaactgagatagttttataataacagtatgtcttttaataaattacagagtgaatagtttaccaaatgttgggttaaagcaaactttcagccacaagattgaatctgctgttttatccacagatatgtggtttttattgatcttatacttccattttattttaaaatgtacattttatgttaccatcctgggatcaaagtaacttgaaataataggaccttaggtaaataaatccttctgttgggataaggatgaacatgtccatcagagttgtctctttttcctttgctttttaacttgtgttaggcaagtgacagaatatgtttttgttgttctctgatcccagttttattctttgtcactttttttttctgccaaacagatgcagtatgtttcaacagaaagagtgctccaaatctttaatcattatgaaaaacacagtaccttgaccttgtattttaaagttaaatggagtggcattataaaaattaaattggttcttgctcatttccataatatcctctaaaaagccttgcctaacctagagtggatgtcctatttctttatctttcttgatgatctctcatgcctgcaagtcagctcgtttttctttgctgaagactgcaccccactgctgcatgcactctaaaagttccattaaaatctagggcatcatcactcattcttatctgcagcaggctgctgagcagtgccataccagcaactgcatgcaaactagcctcaaaggacaatattagctatatacattgtcattctgtaaagagaagattccacctggatcttaccttatctcccagagcatatctagcctttccaacatggctcccagtgtcagcgctatgaatgggtctcttgcaacagcaaggattacttaaaaagcaatttaccagcaagaaattagctttttataggacaccctttattaaacttggtgtgagatgagctagcatcctgaatttcccccttgagcccactgagaccacgcgggccaaaagctgtttcattttaaatactgtactataaaaaattatacgtattcctctctgatcttgatgaattctttcttgggatggatgtgttattaggataataaggcttgagagttgaacaatgggctaggatttggcactgttcctgttgtcctgaaatgtgaagaaatgttgatgtaacttactcaatgagatgttccctaaccactgggaatagttcactgcctggggacaccagaggagaactacagagatgggggagattggtgaaagagctggggtataaagatacaaaaaataaagaatattaccaccttttccttctttattatatcaaatatcatttttctaaaccaataacagagtacttctgtgggaacgaataaaaaagataatgataatatcaaatatcattattgtcaaacttgatgacttatttctccattttatataacttgtagtaccatcattaagtagtattaaataagatacccatatacatggtactataaataatttcctgacaagtattttacttcttgtctaatgaagtgaagtgaagcactttaatgaagtggtgggtgtaccagtctcagaaacattccgaagactgatttcctaagtcttccaataaactttagctttagacggtgggtggggtgcaggtggttagattgtcagtaaaagcacctaagccctgggtaaattctccagacataataagactgactctgaaagatctttgttgaaaggtgctggataccactctgccatatctatgtaatagtatccattcttccaacagctatatatctagaatcaactctgcaatatttcacatgaaagactctttttcttagagatttagtttccattgttatttcctgtagctgtctggatggtgtcaaccaaggtgaactttggtctaaatgatttttcctcagttattaagtagtgtgaagacaaaaaataataaaataaatgttgggaaattgagaggtatgctgcttcagttatggaatctatttcacataaaatagttattccaagtctaaaaataataataaatccaaaaccaaaatatcggatgtgtagttttaatcaagcaaataaatgttttatagggccttttgattaagagctcacagtgagactttttagtaatttataaccgtgaatactttccacactaatttatcagaagcctttattactacattttccagaattttcaagggggatgtggtgggatgaatagtttcccctgaatagtcacatgtccctgaaaccttgaatgtcaccagatttggaaatagggtctttgaagatgtaattagttaagaatttcaaaatgacatcaccatgaatttagggtgggctctaaatccaaagactggtgtccttttgcggcactattcacaatagcaaagacttggaaccaacccaaatgtccaacaatgatagactggattaagaaaatgtggcacatatacaccatggaatactatgcagccataaaaaaatgatgagttcatgttctttgtagagacatggatgaaattggaaatcatcattctcagtaaactatcgcaagaacaaaaaaccaaacactgcatactctcactcacaggtgggaattgaacaatgagaacacatggacacaggaatgggaacatcacactctggggactgttgtggggtggggggagggggggagggatagcattaggagatatacctaatgctaaatgatgagctaatgggtgcagcacaccagcatggcacatgcatacatatgtaactaacctgcacattgtgcacatgtaccctaaaacttaaagtataataataataataataataataataataataataaagaaaagagtggacacagaaagacacacaaagaagagggttatgtgaggtcaggagcagatgttgaacttgtgctgcttgaaatcaaggaacacctggggctaccagaagctggaagaggcaaggaagaattcttccccagagccttcagagggataattgaccttgattttggacacctagcttccagatttgtgagagaataaatgtctattaagccacccagcttgtggtaatttgttacatctgtgttaggaaacaattgcagggagtatggttgttattatcctatattgccaagtgcatacgaaatttggtttagcatctattggtctcccagagacacgtcaatcttaaaggatgctaaaagctggtaggctttaggtccaaagattgactagaagtaaagatttcaggccaaatacacagcagcacaggtttggggggacgtggtggggagaaatcttgtaaagtcaacaatccattttctagttactgtctagtcacgcattataaatgacacaaacagctcacccttgaagtcttaacattatgaacctcataaattttaaaaatcagaataaagtctctgaatattcagctaacagtaaagtctttaatctaaatggatgatgaaaatggagagaatttatgttagctagaaaattaagactactgaataatttttctttcagctagtgttccatataatggtgatattttggcatatatgtaagataacacttactaaaaaagaaattatctgatgcatgtgaaaatttagagacaggtcattactaccgatcaagatgatttgctactgcccatttgagagtataaggggacagtgggctccggtgtgactatgaacatatgccctcagtaagcagggcagcttgcatccctgagaagtaaatgagtatagatgtgctctcctcaaaagctttcccttcccaccaggagtgtttgtaaatgttgaggctaggtggaaagagttggaataggatacatttttgcaaatgatataaagagggtgatatgaatacagaattgtggagctttgaagagaaagggaataatgattagcatttactgagtaccgattttgtgccaaatcttgttgagcatttttaatacactcatttatttaattccaacaagagttctgcagtatgagtagtacctattttacaggtgaggtaattgaggatcataggattaaaaaaaattacctgaatttacacagtatgtgtggatgtaaacaacgtgctttgccattctcttgtattcttggacctaaaagacctaacggtgtggttgtataagcaaaatggatagacttgaaagttttagtatgaataagagactgtggtagaaaaacattttttaaaactgtagatttaattaagtctcaaaaatgctgcatgaaaaataagtgctataggaggtaagaggtgggagaatcatttaactgttcacagaggagtgtggctgtgagctgaagatggaggattaaaagagaagcaggatatcatagtctatgtggagtctacatagaggaagaggcaggagaacttctggcttgaaacatgagcatgatggaacctgagggtcctcctaagtaggtataagagggaaagttgaaaagtttgcatgaacccagaatatgaaagtcagaatatgcagattaacttgagcctgtgaggactagaaagccactgatacgttttgagctggtaactaatgtaatgaacctgatatatttctcaggaagattaataacatagcggtatagtgagagattggtaatggggagatgggaaggaagctaatcctatattcaaacatgattatttttagaaacaaatagaaacagaggaaatagaaaataacaagaggaaggaagagatatccacaagattgcacatgactagaaaggcacaggaagaggtcaaaagtgtctgaaggataactgaaaataaagggagtcagtcaatcttttagctgctattgctgggggtctctgtaaataagttgctttccaagttcatggcctttgaagcacccttcattacaatcagtgcgtttttctgtaacacacaacgttatcataattttgttttatgaggcatagggcaaagaggcaatatgcatttttaagttcttgaaatctatgcatgtctttaagttagtagacataaataatttttaaaatccttcacgattgaattgaagtaattatgttgactacatattcaatgaaaattacttcattattctctaaagaaaatggacagagattactatttttatttggagaaagaaacacttaagtctatgggcctgaaagggttaatacaattaatgcatttttaaaagtctatattactctcagatgataactaattcacttgaagaacttagtttgatacatttagaggctccttggagttcttcaaaagaggttgctacagagttccagggtattataatcattattaattgcagtattttaaagttcacaccagatgagcttccaagaaaaatgacccaaatttatttgaaaggtcacatatatttattttacttatccaaccacatggtgataaaaatagggaaaccatgataaaatccagctcaactaggtaggtagtatggtatagcagaaacgagtccctggatttaaaatctgagagctgatttcctctttgattccttcatgtaccaattgtgtgattttaactatactgcttaatcctcatatgtcttaatttctcagctgtaaaatgggcataataatgtttgtcttacctcagtgaggacaaattttttttttcagtgctgtaattccagcagctagaactgcgtttggcacagagcagaggctcagaaatgtttgttaaattaacacgtgaatgaatggataatgaatgttgtgcgcattcagtaacatgaagcacatgaatgtacatatatttaaattttgcatccatatctattaaataccatctggatattttatctattatatctgggtaatgaaaataactatacaatgctgtgctactgcccgtttctttccaattctgcattcaatgacgtcacactggtagcttgaaattggctatgctggagcatttgtgcaacaaaatttgccaaatgctgcaaatcagacactctctctccccgccaagagcctcttgttaaacatttaccagcaaaccactgttccaggtcctcattatctggcctctgcttatactttgttgtcttctatcttctctacaacttttgctgaagtcattctgaaatactagcagtcaccaaaataatccaggctctgggcgtcactgcacaatctccaccttgccttgaaaatttccctcctagaaatacgtatcatgtcttagctaacacttactcggatatccttgaaagcagtctctgactaccccaagttagacttgggtacctcttccatgtgtttggctatcactcagtggttatcaccatgacggtattatcctaacgtatgataataattgcttgtttacttgtgtgcctcccctgagagctctttgaagtacagggactgtcttattcctaattagagtttctgtatcttgcttctacaggagctacccaataaatgatagttccatgaacaactaaaaaaccccaatctggttttgtacatgttggcaattcaggaaggctaagtgtgttattagtccaagaaatgtagtgaatagacacaaccactcttacataggcactctgtgcttgacatgatttcctgaatgttagtgggggaatccgttacactaatccacacaagtagtcgtaatgctgctggcaatttcccagacattaacaatgaagatcgttggcttaatgcaaatcattgacgcctgtgacagatcaagtcaatattaattcctgtctgatacttttcttgtgacatttgaagtcatctctgttttgtctaaaaatcttattcgtaggacagccacctacagggccacccagaatggctcattaagccaacacatttcttttgcatctttgtgcatgaagggatctagagaaaaactatattattcctgttttttccctcctgcctcacacaggtcagttgttgcaccagtcattgtctatttcccttaagatcatgtccccctgggaactacatttcccagactcatatgccaatggacttctctggatggaatacgtcaatgtgtggcaatagcagggaactaaatggcagggaaaatacggaattcagggtatttctccttctctctgctctggaaggtattttgtggcttatggctgaatcccctcttgtgttccaactttctgcttgacgcatcctcctcctgtggttgcaggtcctgccgaacaggacaggccccacctgatcctagctgcctccagacgacttcaaattctgaaatctcatgtcaccttgtgcttaaagccccagccataagtgagaacagcttcctgcgactgccaatccctgggttgttttgatcttttctcgtttggcttctcaggactctcatcacctacggaattaatttcctctattaaactccctcccttggtactatttggaggagttctctttattattattgttttttaaccattttttcttcatagtactactatcttatttggtgatgaaaatcaaaatcaaaatattctgaattatctttggcttcctattttatctgactcctcaagtctaaacagttgtcaagcccccccagtcctttcaactttcattatcttctttcatttctattctcattcctgggacaacaatgtgatggccattgccttttccctgaaatattgcaatagcctactaattggggcctttgccttcagtctctttcccttctctgtttactaggaatatggatcatagactttacttaagccagcttggatggatagaaagatagaagggattattgtaaggtttgaggtgagacgataagggagtctctggggaattcaataacagcatctgtcataactctgagcatgacaaagaatgaacatataggtggtcctggattcaaggcaacagtagaaatctcatcagtaagagttcaagcaatttcactgcacttctcttccattattgtgcctcagtcaccccctaggtgtctccctcatttgtttctgcatttacccggctgctactgtttcttcaatttcttctccctcataattctgaattgtacatagctttcaaggctacaactctgtcatgttattaaagctatacagcttctgtatctattctgaaattcttgggttttccaagaatagaaatctgattgttcagctaacttcttaatgccaagctctggtttcaatcaaccatgtagtggaggcagttacgaagggcccgaatgcacccttttactgggataggacacagggcagttcatttaggaacagagtgataatctattatccaaacaaggatatttttgagagcaaaaggaggcccaataaatgattacataggataaacaagtagaaagtgggattgttctgagtaaactgcaacttacagtcaacgtatagagtactccaggcaggcaagtattgtaaattgagtctatttccacttgttagtttctctactgctcttcatatatatactgaatatctctttctcagtgtagaatgtcattcattcttccctaacatcagcctgatcccactgctacgtcaagtgtgtgttgaaatatttttttctccatgaagccttccttgatttagctaacaggaaattaatcttttcttttctttcctttttttttttttgagatggaatcttgctgttgcccaggctggagtgcaatggccagatcttggctcactgcaacctccacctcccaggttcaaacaattctcctgcctcagcctgctaagtagctgggattacaggtgcataccaccaaacccggctaatttttgtatatttagtagagatagagtttcaccatgttggccaggatggtctcgaactcctgacctcgtgatctgcccaccttggcctcccaaagtgctgggattacaggcgtgagccaccgtgcccagccaattcatctttctttttataataaatgcaaatcgtacttcaactgtgcattctagggcttgtatttattttctattatacattataatttttatgcatgtactttgtctaataggtgtaagttcttagggagaatgagccatatttaatacatttttgtataccccacatggcctagccaatactttgcttatagttggtaggcaatgaatatttattaaacgaatgattgctgagttttctgaaaacatcattcttgccattgttgttttgagctcactcaattattctggatcctgatgtctatgaaatgcaaaaagataagatattgatcacgtctaaattagaagagtggtgagataaacagaaataagaggattggaagttaacttatttacataatctgaagaatgtttaactggaaataaaacggacagaagacattttgcttctgaagagataaacaaggaatcctagataattgaaagaaaaggaatacatttatttctcaatgagtatttgttcaatccatacatgatttatttagacaaatatctaatttgaacatccccttggtttctataatttataacatcatttacaagttcaatttaatgtatatggaaatcatagtgcatatcagttttgctatttttaaaagtgcttcctaatgaaaagttctgatatttcagaaaacatttacattcttacataagaagcagttaaatagtaaacttccattagtagttaattaagaagcattatatcactcttctatatttgttagtgtatgtaacatgaatcaaagccacctgaagtaattcatggggtcataacgtgcacttttagtgtatgatgcatgttatttaatttcaattaaaatgaagtttcagttgttcttcacacaggcctttttcccttaataatacagattcatttccataatactttaggtgatatgtatgattgtatgatacataataggtttttagcatttttaatacaactctacatatccaggaatccaagcattggaaattgaccccttgggcctcgaccaaatcaagtacgtgagacaaatatgagccttcggtacaactagagtagatttattttattccaaccattatgctccctttagctgtcacatattatgacctgggaaaagttgctaacttctctatagtacagttttctcacctgataagcaaggaggatccctaccttctacctcccagagctgatgtgattattaaaagccagttagaatcttcacatagtaagtgttcaataaacacttgccattactattactagtaacacacgaagaaccctgaaagaacataagtgaaggtcagaagacaaggtggagactattatgaaaatgtttagaaaagttctagttgggtcagagattaaagattaaaacgtttagacccacttaattaaaagacaaattttaacatattagtaataagcctcatattagtactactaagcatactcaaaataggtaagactactgaaggtaaaatcaaagcagtaccagaatatctgaggcacattctccttttgcgaagatggtagttcttaacacccttgtgatttgcctaagatcttaacatactctcaaacacattaatcctttaatcctagaacagtgtttctcaaccttagctacactctgggatcattcaagaaatattttaaaatactgatgtctgggtcctgcctccatagattctgattcaattggtctagatgtgatctgggcccggaatagctcaactgtctccccaggtgattcagatacgcaatcaaagctgagaaccaacagttcgatcgacgcttttcaaattttgacatgaataagaatcacttggagaccttgttaacccacagttttcttggccctactcccaaaaactctgatttagtaggcttggggtggggccaagactttctagttctaacaagctttcaggtgatgccgagcatgatggcctgtgagtagcgttctgaaacttgaacatttggagtgtcagaaccccctggagagctggtcacaacaaagactgccgggctacaccccctagagttttcaagtgagatctggaatggggcccatgcaggtctaagttcccaagtgatgctaacgctgctgatcccgggacctccctttgagaactactactctagataaaaagtacttactctccatctgcatttttaaaaacatcactttaataatctactggctttcaagacattttcaccactaaacaccttatcatagcagcttccacggattgctgtgcctttggattagagaaacaagtacataaggcaaaggacatatatattctccctgtctacttggatgcacagctgcccagcacccagaaaccatctgataccattcaccaagctgatggattgtgtgttgttcattctgctccttatctaatagttcttttatttaactaatgactgtaattctcattagatgctgatagaacactaagttttttttgtggaacttggcaaaactactcatggcaggacatcagttggtgagcattacctaggcagcaacacccaaccctcccgctggcctgagcagcaggtgctggtgctgttagtaatgtcgacataaggaggcaatggtttctctggccatggaagatatgttgtgatttaattcaagaattccttcagtttagaggtctattaaatgaccttctgttatgcaatctgcagtcatgaaatcttaaagaagagaaaacacctttgttttagcctaatggagaacaatcccaaggatctgggaatactattatactctatttcaccttaatgtcctcgcacttgttgttctgaaagcccctccctttccctcctgcttccgggtcacccttactcatctatcacatctattttagcacccagactaagatagtaccacccgagtgaagtctttctcaaatgtcctatctctggtcatgctgcctagttcttggagtgcatttccgtcatggtactcattacactgcatgagaactgggattatcctactcacctccccacaaagcacaagcacataggacagaggcggtatctagcacatctttttctctccagcacttcctagcagtgcctggcacagagaaggtacatacgtaacatcttccacaagaagttctttgaagcaccaatcccaccatctgctatacttgctagtgtttccaagatacttctggatccctcggtatttcttccaaatgtagtgtttatgcctttgatcatcagtgatcatttcacaagtgtgtgtgctagccctgaccataagcaccatgagaatctattgtgttcacagttttatcatcagcatttttagaatatatggcacttgcaagttctcagtaaatatctgcctgatgaaacaaataagtttctgtaaaatgggctgttaaacacagatgaaaagtttttaaaaacatcagggcttcagttaagtaaatatttgggataagaagctgtaaatactaacgtcgagtgcaacaaatatgtcaacacaagaagtcattgagtagaagtattgtcataaaatgtgttgggagctttttatgctcccataaaatgcttggggagcaatccttttgcatttagagaccatttagtatttcttttggaaacggctttgtttgaattcccattccatttacgggcttcttccaaagaatttcttctcagatatgtctggaatctcctttttaccttttgattggttattgtttgggcaaacactcattgtcaactagcaactgataagtaaagggaaaaatacaattaccagtttttcaataattttgaagcatcaatagaaacggattaaatatcacattgccttcaaaaaggggccaaggtaagggagataaaagaggcaaatgggagtttggaagctctgctcaaagtattatgaatgttttacaatgtatttcaggtcaacaaacattggcatcgtcgttgcatttttcagaaaagaatgtaagctgggaaaaaagtttagaggcaaattaagacttgagagacagttctaagtggaaataagggggatgggaaaagaaccctgtattgaaacatcattgatttccttctcacccataaacctacactctgctaaaatgtgttaactgcagcaaaatgattaactcggtgagtctagcatgtgggaagtaaatgacatatgtaacgaggaactggcctggaggtagcgccagaagtatatccaagatggcaagatgaagcaagagtacaacaacttcctggtgtagtgcctttcagaaaatctccctctgttttgttgcacatgacttctttatcttactcaactcattgtgtaataaggtagaagtagaaagaacatccttcaaaattattggaaagtgacagaatgtttgagtggatggctttgcaaactgttgaaaatgtttcatcctcaataccaaatgacatttctgctagcataatgccatgcttttttcccccttctaatactatacaatattagattttgcatggaaatcactccatgcatccatttgacaatttatcgagtacctgtttcaagtgctatgtactgagaatgcgcccacgaacatgacagataatatatctgcacataatttacagtccagtaagaattacagcttagcttcttcctgtcttactccagataaagacccttttccctcattccaccctctcaaggtgcataacttaataagtcagcatgcttaatactgttcgatctaattgtcttgagaatgtcattttcttcccatcccacctttttcaaaagtatttaatgactcctttttgcacagaggttcacattcaagctcctcaggctaacaactcatcccactgtaaatttgtattaatcatattctaattgtcctcttttgtccctcaacatgggcctgccactctggtcactccttggctgctcaatataccacccgtgttctttgcgggggagctcaagtcatttgttttttcctttcatctgaagacacatttgggtgagacttggggatttgtatgtttaagcacccagagtgactctgacataccactactctatctataaactctgcttacaacctaaggccaattcagatcctactctttctagaaaacattcattaactgttacttctcatcatgatttcttcattctttatagtacaataacacttactgtctcatttatttcggcatatatagttccagagctatgtaattacgcctgtttcatagacacaggtcttatccctccaatgagaagacatgttctataggagaagcagctattatcttggacctgtattgaacttctcaaccgcacctagcatggctctaagtatacttgcagcatacattgtgtacttattttattttaacatcatgactcttctagcaacttttgtgagttgcatttaactttttcagtctctgtagggcttacttcacaataggtctcagtgaatgaattaacccttagagtgtccgtttcatctaaaggaggattgcctgtttttgcaagttccagcatctaatgtttcaccttgaaaaatattaaccctgatgtaggtcaaatatatgtaaagctgtattaactttgtttttcaaagacatcatcatttttttcttttttctctgtgagggcttttttttttcttttataaagtaaaaataatttcaaaaatcatattgttctcttgtgatgagaaagcacatacaaaattttatttaagcaacttgaacacgcatcaaattgttccctttgacaaaaagagaaaactacttgtctgggctcactagattaccatgtactatgtcacgacgaatatatttctaaagccaaacatgaaaatttaattatcttgagctacataattgttcttctttggcttcttgccgaattttataattttttcaatagatcgaactgaatttacaagataatctttgaatttaaaacaaagtacattactttttaagccagtaagttaaaattccaattctaaaatattacagtgcactcccaaagcattgtggtttaaaatattcaaaattatataatgataatctcagtgcttttcagttttaaggtattcatgttttagtcaaatgtgattatacttttattcgtatctttcttacacatgtttcaaagctcgtaaaataattatcttatttgttctaaaacttccttacgtatgctgtactttgtcccatctcaatgaaattacatgcagcaaatttgttcctaagtcttgtgttcaacactgagactgtaattcctgacgctgtcattctactttttgaaaattttacattcaaatagaatatctcaactctttctatttgtctgtcttcagataacttattttagtttgttaaatctcagaattttcaccctattcatggggctaagttgaattaattcttaaattgtgaggatttggagaaattatagatattaaagccctagcacaaattctgaaacatagcggcttttttgcaaatgttcattttgcctatggatccacctgcaaggtgggcaaggaaagggtttgtagttctattgcataaggctttgaaattcactagtagatcacgatcagtggattgaatctgctgccttactatctacgttaaagccagttatcagtcttgctggcacatcaacaaagcctgtctttctttcaattaaaagttgcaattacaacttgctttcttttaaacctctcgtagtgattcaacctacttgtccccaaagcgtatttgattgaaaatcatgctgggccggcccaacaaatttcacacttatgagaaattcaccaacccttctcatatcatcagcttattcccccatccaaaagacattcccagtaaagtaacattaactgtttagttaattaaagaccatcttcagaatatagaaactgttatggactgaagtaggtctcctcaaccccattcatatgttgaagttttaacccctgcaagtggaggtagggcctttaaaggggtaattaaggttaaatgagttcatatgggtaggaccttaatccaataagtctaatgtcctcataaaaggaagaacagctacaagggatgcacatacacagaggaaaggtcatgaaggagaaggcggctatctgcaagccaatgggggaggactcaccagaaaccaaccctgtcatcaccttaatcttagacgttcaacttccggaactgcaagaaatacatttctgttgcttaagccacccagtgggtgtttaccttgcttaagtcatggatattttgaaatttttatatacaaacaaaagtaatgccaattaataattatatctatttaacaactagctatatattttatatatccaaagttaatcaaccgaattgacccagtaagtgtaatctttgcttatgtaaacaatacaaacccttagctcatttagattggctccaataaaatattttttaaattcagttaaagtcttaaacatggatcacttacatagcaaatatgtgtgcactacaaattgcagctaatcaatcatttctatttatgtgtgcataccctatgacctgacaatactactagcgaatactgttgagaaatttttaaacatgcactataaaacatatacaagaacacatgtgtgttgtggtttgtgatgaacaaaaacataaaaacaacccaaatgtccatacgcatgtaaaatatatacattgtgttatatacatacaatgagttgcacattgatgaacgtaaatatgtaaaacatagtattgagagaaaagaattcacagagaagattagagatggggtggttcccttaatataaagttcaaatccaggcaaactaaaactagctactctttaaagatacaaatacaggtgttgaacatacgttttttaaaaaatgagcattgtttactagaaattcaagataatggttacttttggctctggggggaaggaaggtgattagcaaggggtaacatagggagcttctcccaaaatactgatggtgttcttcttatttgaaactcagaatgttggaacacagatgttcatattattctttaaacctgtgctgtccaacacggtagccattagccacctgtggctattgaacaattcaaatgtgactaatgcaaattgcaatgtgccataaatgtaaaatatacactagatttcagagacttactaaagaaaaaggttaaatacataattagtaatttttatattgattacatatttaaataattgtgatttggatatactaggctaaataaagtatcctattacattaatttctctgtttctttttctaatatggctagtagaaaattgaaaactacgtatttgactcacattatatttccattggacaacaccactttaaacactccctgtaaacgtttatattgtgatatatttcataataaaaaataaatatgtgttaattgtataataaaatccaggttttcacccttaaggataaaaggagtagttttcctttctaaatacaatataaaccagttcaatggaacttataaaactatggacaccttctaagtaagtcattttttttaaagtagtaggtatacattacctcaatcattcaaaagcaatgagatgtggttaatttcaacacatatacagaatcacttttttaaaatctgctctaaaaatccagaaaaggggcctggattttcccaaaggcaaatctgagtggtgagttgatatattgaattatcactgagaaagaaaccaaaattcaatgaaatcttaatatagcctacgtggacaagtatacaaaatttgagcatagcaacgatacaatttaaggattttgctctaaactaattcaataattagggaagctacagaatgcctatattaaaaattatctctcctttgtggaactcaatctgaccatacaatttgcaaagcagataaattacataatttagcattgaatacttcatctgaatagtaaggtatgaatatctaatggcctctctgttttctaaaatctgctagagtcagaatgtcatgtacaagttctaaagaatttttaagagaaaaagggaattaaaggttattgagactttgaaatctatttttatcagttgacactggaagagaaacgtgggtatacacacatacatatatcttctgtctttatagtttatatagattcaatggaaaataaattcagaatctgaaaatgaattttgatcaggccacaggatgtgtgatacacagaatggggaatgcaaacagggaaacaatgtcatatattgcaaaaaaggatttgtttgggcttggaatcaaagagaactcggtataatcctctttttttttttttttttttcttctgagacggagttttgctcttgtcgcccaggctggagtgcaatggcacgatctcggctcactgcaaactccgcctcccgggttcaagtgattctcctacctcagcctcccgagtagctgagattacaggtgcgtgccaccacgcccagctaattttactatttttagtaaagacggggtctcaccatgttggccaggatggtctcaatctcttgacctcatgatccgcccgcctcggcctcctgaagcgctgagattacaggcatgagctactgcgcccggccagaacttggtataattcttccattcactttctttgcaacttcggaaaaatttctaacttatgaacatcagttttctcaattactgtataataactatgctatcactttgaaggattcctaggagcattaaatgtagggtgcctgtcctactgcaggtatctaagacctggggggtattatcatcttagtttatcatcaaataatgctagagaaggaaaccagcattagttctgctgttctaccctcttcactaacagaatttgataatctacatttgagtgagacctctaaataatagaagacatgcagctagtcacaatatcgacgtgtatgtctcactctgtcaataaaactgcacttacaaaaacagaaaagcaaaaaatattttatttataatgttaaaggaagagaatggtgctcctaaaaagaaaagggacataaatatgttaaattgacataaatatgtcaagaggaaaatagcatttctctttgaatataccaaaaagtacatataacatcacagcactattcacaatggcaaagacatgcaatcaacctaggtgcccattaatggtggacaggataaagaatgtggcgcgtatacaccatggaatactacacagccataaaaactaacaaaatcatggcctgtgcaacaacatggatgcaattggaggccactatcctaagcacgttaacgcaggaacagacaacgagtactgcatgttctcgcttaaaagtgggagctaaacattgagtgcacatggacataaagacaggaacaatagacactggggactacagaggaaggagggaggaagggaacaggcaagggttgaagaactagtggttaccatgctcgctacctgggtggtgggatcattcatatagcaaacctcatcatcatgcactatatccagggaacatgtacccgctgaatctaaaataaaagttgaaattataaaaagaaaaaaagaaaacctcatactaacattctttggaaacagttaaatgaaattattaaaagtatgatgatcatgcatgtgtacttcgcttaaaatatttatgtatgggccgggtgtagtggctcatgcatgtaatcccagcactgtgggaggccaaggcgggcggactgccagagctgaggaactcgagaccagcctggtcaacatggtgaagccctgtctctactgaaaacacaaaaattagccaggcatggtggtgggcacctattatcccaggtacttcggaggctgaggcaggggaatcactcgaacctggtgggggcagaggttacagtcagctgagattgcgccacctcactccagcctgggcgaaagagcgaaactccctctcaaaaaaaaaaaaaaaaaaaaaagtatgaaacaaacaaagaatatattattttactattttagaagagaaaagctctaggataggcagcataacatatggtcagaagcagggacactagagccactgtcttggcagtatgaccttgggcaagtaacttaacctagttatatcatttgctagctaaataagtataataataaaacctgtcctgtgggattgttgtgatgattgcctgaattaatgtagagaaagtaatttgactaacgtctggctcagaagaagcattactacaacacttaggcatcatcatgattattatcatcatcgccatcatcattattactattgctgaaatgaatatgaacagaaattaagtctctgaaaagcaggaagccccactttatgagggatcatgtgtccaagaagaacagttgctttcaaatatctttttggttgcaaagtttttttcttcttcaataaatgcaacaggggatcccaatactacaattaaatcagagtgcatttagttgaacctggttggtagcctcaagtcctcatgtgtgtgtttctttccactatacttggtgttctctgaagcaagtcaatatcaagtagaacagaggcatttaatgttaaaataaaactagaataaggcaacaaagaacatgtataaggatgcatgaagattgtctctgggttgagagtactattaaaacagaaatcttgcatttgacttcgtatcacttaaaagcacttagaactattttaatttaaaaatcctactattaaaaataggtttagtatttaaagaggtaaattctaattttctataactgcagtatctgatgacaaccactagccgcatgcggcttttgaaatttaaacgttatttaatattaaataaaaatttagttccttagtgtccctggccatattaccattgctcagtagtcatgtgtatctagtggctgttgtattggacagcacagagacagaacatttttatcatcacacaaagttatattggacattgctgatttaggacattttgttacatggaaaattatgctgacaatattaggtgtgcagaatattaccataagcaatagcaaaatactacatgggtttgggaacacttttcctttctttatgcactgcagttaatgaaacaacttaaatgtaattctctggaggaatttattttcttaagtacttctcttaaagtgtctgcaatatgatttttacctgagaagtgtggcacagtaggaataaaaacacggtcagagttagcaccttcatgaccttgagaagtcaagaagtctccctaagacccaggggctccaggtaacagggataatgacagttgtccaccaaaccagtttacatgaagaacaagtgagaaagtgaatagaaaaacccttcgtaaactctgaaatcctaaacaaatgttacttattatgatcatttctacatgtatttttttcatctggatgaatgtgaatgaagtgtataatttctgtagaagtagtcgagctagtctaaagcaaaatgtcacagttaaagcatttgagataaggcacatttgtggtccaaagactccagggctactgattagagaaaaatgcatgtctggttaaatacatttatatgataattactagataatctggactttataattcagatataaaatattttgttaaatttgataaaatgttgcctcatctccatttcatcaactgagacatttattttgactttagctttagagataataagctaagagctgccacttagaagcatattaaaacttcacgaagttttacaacatgctaatttaatgctttattagcttatttcatttaagattacaaagaactaaaatgatcttggtgaagtgttgatccaatctcattccacaatgggacttaatttctgcctagaaggcaaacttagacatttaaatttggaaattaaaagaaagaaactgttatatatcagtgttactaaaccctgaagacaaaaacatatatagagaattgaaaattaatgtagttcagctgcctgagatttaatatgctgccaaaacaaaatattattcataaaacacttttcaattgtagagactaaattattttcctcctaaatatgtttctttctcccctttcaacgattaaaaaatgtatctattcctctttgtagcacatagctgtatgtatacgtaagaggttaatgccagtagctataacaaagagatcccacaattttagtggcttaagaaaagaaagaatactacaaaatgggcattcccatctgcaaacagcttttctctacccagtaattcagggactctgagtccttccattttaggctttttcatctcctaggtctttgggactcttttccataaggttagcaaatgggaagtaagaagatggaaaaggtatgcctgcaacataactcccactcacattcaattggtcacaactagtcacatggctctaactagatgccagtggggctgggaaatgtagttgctggcttgcagctggatcctagcaagaactctatactatgaaagagggaccacgaattttgatgtacacttgtctctgccacaacatatgcttgaaagaaaagaaaggttgagtattatgacacacacacacacgcacgtgcacacacacacacacacacagagagagagagagagagagagaagcgggggaaggctggggagagagagagagagagactttcatatttttcatacctttcatcctgttctctagcatctaagtaaatagaaatgctgtacctccccttctgttaactcatttttctcccttaaacatgtagaagacaaagtaagtcctggcagagaaaaaaagcttggtgtaaagaagaaaggaattcttgaagttggggacactagagattatcagttgtttttatttttccctgcatcaaacctggattctttcctaataccccttggtttgtagttctcattatcagcatgaaatgaaagaggatgtaattcagggttatagccccaccataggaaccctgaactacagtcttaagaaagtttaagactgaaccctttagcctgttaccttacacaaagcactgtggagtcccttgaacttgagagatccctcagattaccgtggcagcctcttatttcacaaaagttatgtcatttgaaatacagaatcaatacatccatcttctcttgaggaataatgcgagtgctgtcaaatgcctactaaaggactgatgtagctatcctgactgcaaaatgtccttcttgacacaacaaagagcacatcagaccattcagtatttatacaacttgttctttcatctaccacagatttactgagcacctgctatgcgttaagccctaggccggaagttatggatacaaagacaaacatgagtgggtctttaagcaagggagttataaggtcatatttgcattaataaaagtcactatgaagagtagagaataaattgaaggagcaagaagagaggcaggagagggagggagagccagtggtgaagagactgctgaatcaatgcaggtagaaggtgcaggctacccaggtaaagaaatgactgttcaaatgaaaacaagtggataaattcaagagagtttattgtagatttggtaggacctgataaatgaacgtgccttactcgagtatggtggtgccattgtctgaaacaaagaagcaaaagaagaaccccgctcgatggtaggggaaagcttgtgagctgagtttttgatcttatagaaattaaaaggttggtcaagtgtatgaatggaagcagttgcatatacaagtctggaagaaagaagatgccaggatggagggaaaatgtagttggaatcacggaatggatgaggatgaccaaaggaaagtctgtaatatgaaaagtccaggaaaaatccaactttttgaggaatattaaagggagagatgccagaaaatgggctcaaaaaggagggattactaagacttaggcagtacatgttcattcaacaaggagattctggtactacagaagctaaattcccttaagaaggaaggcattttcacccacagcattttgctacagaatgctcgagtataatcagcactaaaaaacatttgtcaggtttggcaacaagaaagttgctgccgtccttcttgaagtgaactgaaggaaaggaggaaattgaaatttattgaacacaaaggaagtgtctgaggaagtgtcttattaatgagatcccaatgcggcatcataagcaagtgatggaagtctctgcatataccattttttttttgtgcagtgttataatgctatattatcaaacaaaacactttctttttcttcatcctcacatacacattttcattttagaaagtcaacgtgcttttacttagtactagtaaatatgtcttgccaaaaagctaaaattgtgtaaatcatcaaaagtctataataatattaatgctctgttttgaacatactgaagcccaggaattgccttatttcccccaacaaccctgcagcttttctgaagagaaacctgaggttcacggatagtaaattatatgccagagatcaagcaggtgggaagatgatagagatgaattttatcccagctctgctggttctttcctcctcatttaacgttccaccaccttattcctttaagctccaagtaccaatctagagatttttataattaattcctaatgtctgatgaaacctgaccgacctcatgcaaaaatattaaagaatacttattgaataaatcaatccaagatacaattgaaaatgtaatttaattaggtagaggtcaaacttcacaaaacagaatataacataaataatcaacaccataggcaataagatagacatcttattgcctcaatttctgcaggggataaattgggaaataaggaacacctaagaatcagaaatgaggtagaaatattgaaataaaaacttgatctagaagatcacagtaagttcttaaaacgcggtcctcctaggacccagcacaacacgtaataaatgctgcctggtttgaattgaacttaaggtagcattaacaagaacttgggaagtgctgacacaaaatggattctcttattctagacaattcttgtactgaatgaacttaatttctttcagttctggcatagtttggatgaatcttcctcataaccatctggttgtcttccttcaattctgtgctgctaaacaaacttctgtttttaatttgttttgctaagtaaacttagtcatgaggaaaatgttagtctatgtggatggtcgtgtaatattctccggtaacctttcccccattacaaataatcacattgacattgtgctcattatccactagtttgaacctatggggttcaatgaagaaatgcatttctatgtctacatgcttagcaaccagatcctggtctcagagataaaatgccaggaagaaatcactcgacgataaatccacgtctcagaatttgctctaagcctgagaggagatgacggagttatgaagtgctagatgttgaaactcttatgtgcagacttcttgagaatggagttaaaaaataaaaacagagaaaatcaaagtcaaagatataaaatgttgagaaatcaaacacctgacattagctatgagaaatgtttatggcaaacactgatcctcgctttctcccaacaagctgttatctaattgttatttgttgtgtgatctatatccaccatttcaatcaaagcatgagcaagacttatttcaatagccatagcattgctcccagacaaacttattcattcctcctccattcattatatttagctctgttacagcatcaactgtggaatcctgaaataattctcttacatgtctgcctccttcaccagattgtggagtctgtgaaggaaattatgtactctacaaatatttattgaacacctaatatggaccagagactgttttagatgataaggagatagcagtgatcaaacagtcaaaaatttctgtccatgtgaatcttacacttcaagtaatgggggatgatgtaaatttggcattgaagaggtttggcttgtaacttggaatcattattttctagctctatgaccttggtaaagtcacttgaccaaaacttgagctgtcttatttataaattgaggatcataataccttatagcatggctataagattttaatgaaatgatatcatatggcctaataaaaaagtagctaagctttactgtatacctgttttatagtagcactgttgtgctttaaatcttacaacaagtcttcaagataggtatgattataggaaggttaaattacttagatagtcacaagttagctagtggaagagctagaatttaaacaggcagtttaattgcaacatctgccctgttattcactgggctctactctgtatactgctttctttagtatcacaaagtgcctgccgtatagagggcagttgtgacagtgaggatgctattagttgctcataacataaagctgcactcaaattaatcaaaaacagtaaacaaagggattctactggttcacgtcattgaaaactgcagaagggggctgcaagtgaagttcaatcagggggtcctgctccatatctctcagtactcttaggtctccctcttgtgtctgtcagccttatttcaggttatcttctgtcatggtattacaaaggctgcagctctaactatcacatatgtatattacttagttcaacgcaagagaaaaagaatttcccagaaacctttgcagtaggtctccttgatttttattagtccacagtaggtcatgaggtcatctttgaacctgttactgtagattgcactggttcatctgggcctgaggtatatgctttattcctagagcaataccatttgcgctccagaggagagttcttaccaccgcaaaaatccacatattcaccaagggaatctctctcacacagtcaatatagtttagttgaattaattaatgtctcaaaaataaattaagcagttctcacatatttgtagacagtattttctaactactaaatgaaataacgaaagtaaaaagaaggcaaaagaagaaatactctttaagcaatctcatgtagtaatattcattcacgtaatcattcctggcatatttctgtttgaaattcagtcatctacatggaaacagcggaaggggagctcaggacaatatgccattaatatttcatacacaatctgtttaacactaaacaattcatttttataggagttttactcatctcccacaaattcaaatgtttgtcttgctaatttttcatatttaaaatttgcttttcagctagcattcattcactaaaaggtctttgtacacctaatacttcgagttcaagctcatgcagaactattttattattttctagtaggaagaacagataaacatttcgttgcaaatgtggtagagttctgtttttaacgccaatattatctgtgttcaatgcattatctcttatgagctacatatttttgggggggattatattttttagatgtacctatttagtgttccaattaggttaatgctgaccgaaagattttatacaactaaaataaaattaaattgattgaagatatattttattgtttatttgaaacaatacttcataagtgatatgattttagatttatactgtctccatttcacattttcatttttagagtactttattgttatttagtcactgaatcttttccacatccctcgtaagttcaatctggaatgtatatgctagtgatttgttaaacatgtaaaattaaagtattgatttttaaatataatgtgtatatatttatttatagtgatatataacagttgtatgtatatgggggctacatgtgatattttgatactttttagattgctcaatgatcaaatcagggtaattgagatgctgattttttattttgtaagaagtaacagaaatgggaaaagaagcacatggaaagcgcttagatgtaaactacttgagtgtcactgcctctgggttagcccaatttaggccatctacacataaaagctcgatgtggttatttcagaaaaaaaatttagaccttaacaagtagggtccttgcccttgggccccatgctttcaaaggcaaagctctgattaggagtctgtaggaccaagccaacatgctcactagaagccccgctcccatgatctggcattcagaatccctcaactccctgggcaaatgtttcaaagtcagttactgggtatggctaaggggtaaatctttgcatgaggtgagtgggaaaaacttgaacatgtgggtgggaaatggggcgaccagatctatgtgcacagagttcctcacagtgcaggatggagtaaaggaggtagggaaaaaaggcaacagattcacaatagctaagatgcagaaacaacctaaatgcccattggcagatgaatagataaatgtggtatatatacacaatggaatactattcagcctttataaaaggaaattctgcaatatgaaacaatatggatggaccttaagattacgctaagtgaaacaagacagacacagacaaatactgcatgattccacttacttgaaataaggtatctaaaacagtcaaactcataaaatcaaagactggactggtggttgccaggggctggggatagggcgaaataggaagttactaatcaacagacattacatttcagttaagtaggatgaattagctctagagatctgctgtccaacattctacctagagtcaataataatgtattgtgcatgtagtatttattaagatgatagatctcatgttaaatgtcattaacacagtaaaattttttttaagcttaagaaaagccaatgtatcctaaataacaggcttagggttagctctaaccaagctgcctcattccagtacaaaactctaaggaatttattttattgtatcaagtggtttgctatttgagttttttccaaattccttgccagggaataaactgcttgcactatttaaaaaaacaagacagacagacagacagaaagaaagaaagaaagaaagaaagaaagaaagaaagaaagaaagaaagaagaaagaaagaaagaaaggaaggaaagaaagaaagagaaagaaagaaagaagaaaaagaaaatgagagagagagaattctaaatcgaatctagatgtccatatcattatgattgtataattgtcaaggaaagcagataggatatatttaatagtctgttgactttataccttataaatattaaatatgtggcatgcaggcaaccatttgcacacttactataggccctgcaaaagttatggggcagttctaacctcatatgactatgcagaagactatgtgatacagattatcaaaagatgacaattttttaaattcccagaccaggatggtatgaggagtgagaagcttttttagacaccaatgcatagctcttacagctgggatgctctccgaaggcattattattcctttttcttaagggaatgaagccagacataacacaagttataagttacgagttagaagccatgacttgaacacattcaaaagcatttccctggcatacatttctaatgtgtgaatcttttgggatccatttgtttctttatttctggcaatataattaagtttctaactctaagctcaacaattaaattgatagttcattagcattttagaagaaacacttcaaacaacaaatttagctttagaaaagaacaggtaaaatttgttacattgatcacattttctaaattaattattttaaatgtaattgaataacctatgtcctataaacataaacttgactatagagtcataatttttaaacactgagtctcttcataaattaccacactatatttttcactgagaaattaaaactatgatattttagctaaaatgtatcattttgaaacccaaaatatagatttcacttttcatgttcttgagattatttttcctgtagaaaacgtatatgctgaaagtggtcattaaaataattatggctctaaaactgcaaaacattgctaacatactaagatctaatacagtttcatggtgtcaaaaatagagtatttcaaagaagatttaaaatggaaatgtaatgcattgaaatcaactcaaacataaatttcacacatattttgcttttttaacaaaagccagcgttactgcccaaaatgtaaatgttctggtaaaggaagatatgtacgctattttcaccaattaattttcataaaaagaagcctagtaaatagaacataaaataaatatttaacatccttaaatactaaaaaattaattatcttcctaaggaactgtgacaaaaagaaaaatgtgatttcttgctttgtaggtcaaaatactttatttgctacttaaattttcaattccattcaacaactatttactgacttgttcttatatgccagaccctgtgttagaactgtgtacacaaattaatgtgatattgtccatgttcatatccatagtccaacccatcttagggagtttaagaagcacttcatcttaagactaaagctattattttaggtgtgtttataatatctaaatcaaaattctgaaatacaattattttgcaaaagacgacaaaagcatcattttactcaactgatcctgaagttttaaggcatatttgatttaaaaaatttaaaaaagaaagaattggggttgggaaaggggagtataaactgatgatataaaaatcactcaatttagactctagtaaggacacaagaattaccaaaacagttacttctcatttaatcattttggtttgtttaaactctttagttatttgggaaagaaatgtattgagtacctgctgtgtgttagatatggtgctaggtcctatatgtggatgtgtgatatgactgatccagttcttatcctaccgtaacttacattctagtaggcaattgcatgagagttccttaagagctataatagcagaaatacaggcttctaaaaaacagaaagaaatacaccttctcctctactagagtgttagaaaaacacatatagtaatattaaatatatacagatacctaatcagacttattggtttggacagtgggataataaggctagtaatgatttcctggtagaaaaaaaatatgtaagtcttcaagagtatggataagctcagataaagtaggaatgggagagataggcaggggtggtgatgtttagagccactgtgaatgaattcatgtcccaacgaaaaaaacaacagggaacgttaggatcgctgattccgggaattgtacagacctttttccttgcgtaagctaagtagtttttagagttacaaggaaaagagatgtaagagactggaggaagaaacatttaagaatctgaaaggacttaagtccatctgggaaggaaaagggaaagggaggaatggcaaaggttagggcgaagtgtgttagggggagtagacaagtgagagagtcctttgtggttaaagaactagctaataaactaggtctgaaagttgttactctatccctggaagaacaaataagaattactgaaggcttttaggcagaaaatgaacacattcagatttttgttttttaaaaaattactctagcttttgtgtagaaatagattggagaggagcaagactgaaattccagagtctagggtgtagaaatagattggagaggagcaagactgaaattccagagtctaggcaagagatagtgttttgaaatctaagcaggagatcagggtcatctgacttttggttttgggtgtaaagatggggaaaataagacattctagagagaaaatgtaagaacgtatttaacaacaaaacttagtgattaattggaggtatagatggtgtccaggcttctgctttattcaactaagtggatggtggtcatattaaataaatcagggagccagggaggagaagcagaatttatagatgaggtgatgagctcaggtgagtattttaagcttgaagcacctgagggacatctaaatagagatctattagacatttgtgtattcttgtagcttcctcagaaaaatgatttgggctggaattatagcttaagggtcatcaacataagaatggtaattgcgttcaaagacaagattacccacataatgtcaagtaagaggaaaagaggtcctagatcaaaactatgaaggatgtcgtcaatacttaatggaagggcagatgaggaattcacaaaggagttaagagtgtagagtcatataagcaaggaacagagtgttttaagcagaacagagttgacagtggtccataataaggtgaactaggataaagactgtagaggacccaccaaatttagcaacatgaggaccatcagtgtccttgatgagagtacctcccatgagcctttgctgctagaagtcaatgtgcagtgtgttaaagcagggctggcaacatgatgtggagacaacaaatatagataggttgtttatgatagagggttatctgtaaaggaaagtcaagagggaaataaccagtgtagcacatagacttcaagggttgttttaatgattaaacaaaaatactagagaatgttcaaatgctcatagaatatgggatcaatctctttctcaaaatactgataggatgatgtgaaaaatcatgtcttcatgagcaagcaatgtggaggcagtatattcccacagaacatattcatggaagtgttaacacaaaatattttaccaagtaatgaccatctctaaaatcacatttgtaaaaactagcgtgctttattaaatcttcatgggcaagattaactgatagacacagagcatttatttgttcaaatgttgagaattacaaattgaggaataattatttctaatgatagattcttaaaactcttattattaaagatataatacactaaaacaataattttcagttatagcctccttccattgattcaaacgaaagacacacaaagtgtaaccgtgcataaatactgtcaagctttgaggaatatcgatttctggaaatcctccgttttattggtaccgagattttccacagaaactcactaagcaccactttttgtaactatcccatgatactcattatacgtgccatgcacacggtcaatttctagtaaattagaaagtaactagcataatcctattatttatttaatttcaatgatgttatcattgaatctccagtattctagaaattctttgtttccagtgtatattcatatatggaataaaccactatttattttaaattatagcaattttagaaataacctcattattccaatttttcatgttctgcagacatctcacaactgaacttcccaggctacaactttaatgtggcaaacacataaccaaaccaaagtagaactgaccggactgtggcagagcacatggtcatttgttcaatcacttggtcattcaacaaacgtcttctaatcagctagaatatgtgccaaggtctggccttaacataagagatacaaagaggaataaactgtaaatagtcattgctctctagggcaaatctagggaggaattcagacaaaaataaatcctcatataataatagtagaaaactcaaaagggacattaagacggatctatcgactgccttaagccatgatgttggactagggagattatacactaggttcgtctgggaaaggtctggtgtacagctttgtcccgtgacctttcctacactttttattctcaaaataaatacattagcaatgatcttgtaaggtgaaacaaaagtccatcaggaaaacaggagttggcgggtgggaaatggtaccttatgaagagaacaaaggaaacaatagcatgggatatcagagaaactctagcaacacagtatagctggggtgaagagtatctctgggcgaggtcatcagggacaaagtcaattagagggatagacagagttccaagtgtcagggaccttgttggtcagactaagcaatctgaactatttggaaagcaaacaaggtaaccctggaggattcctgaatttcaatctagaatcacacactatacttttttttttttcaattttgcatgacgacttcagggaaacatgccaatgaaaaaatcaagttaaatcattacattaataaatttacttagtctaggatttggaatatttattgcaagtcaaactaacctgttagtcattgcatataaacaggttggctaaaatcaaattttaaaatgtagatatcaataggtagtctctgctctcaaagggcttacaatttccctgtaatcgtgtcacttggatcagcttacacagattataatcagaagcagagacagcagagataactcctgaatagagaaactaggttaagaataatgggcatagatatgtctgtgtgtgtatgtgtgtgttttagataagttactgatcttctctgagcctaagttttctcagatgaaaatgagaaccatgaagccttccttacagggtgaataatggcaatccaatgtaaaggagggggggatatttattccaggaaaaacgaacaagagaagtagaaacaacacatacagtgcttgcaaagtgtataataggccttcaagaaatgagaattattatgctatgtcacagtctgatctcattagatactctcaatggcctcatgagaaggatgagaaaggaatacatttctcccattttacaggcgagggcacaaagagaacaaaaaatcaattatttgcttcaaattatacagctatttattggaaacacttgggctcaaaaatatcccgtttccaagtctttaccctttctaaaatgcacactgtccgtgaaacatgccaaattgattttatcatcactaagatgaacttatccatagatccttgtgcccccaaatctcactgtctcagttcttgggtgcctcaagtccaagttcccagggcatctgtctatgagtaggatattcacagtgagtaaaaaggtaatgccataaaaatctaggtgtgggttagtagaatccaaataaacgatatagaacatcacaactcatattcaaatatgttaactaaagtaatgatttcctattacttagagtgagggtctcaaaatgttcctgaaatagatctcaaaatgtattccctctgtctagttgaaactttgtaatctttgaacagtaactctctattccctcactccacctcccaagcctctgttaaccatgattctactctacatctctatgaattcaacttttcttacattgcacatttaagtgacatcatgtggtatttgtctttctgtgcctgggggaaaaatgttcatgtacctcagaagtaaacacattttaagcatgtaccctatataaatatatattcacagacatatgtaattttaaattacattgacactagttttgtagacacaacttacacatcacatacactataaaatatacaatcaaaatattaatttctagagaacaagataaataaaaagtattttttctcactaccccaactgtttagcacgcatattattgggcatgtacattccactttggtaacaactgacctagataatcaaattcaaggtcgttggagtgacaaaatccttcataacttcactggtgtgtgtgtgtaagcgtgtgtgtgtatatgtgtgtgtgcttacaatccccactagattttaaactcaaaagagaaccaacaatgccttcatattttttcttctctctcttcaatctgtgttccctgagatccttttctatttggttcactggccctttaaccccaaagcagtttccactctgtggaagaaggaaatagtttcattatattttggctctgggttgtttcttcatttaaaaccgtagctaaagtccagaccagagaatgatttgaaaaccataccttaagaatgagtttttcctagtacagtagacataagaactctctggatgggggggagtcaaaaagaaagttggggaggaagcaagaaaattagatgcttgtaggtttccgaagagggggcctgatgtggcagtatttcatcagcaagaagggcaaaggcagattcactaaatttcttgaggcctcagagtgcagccagcaagtggctacatttttcctgtccctgaaaagagtgtgggagttgactgaggaaaagagttggtcatagcaagagatgcttaactgaaaagctgcatgggccatgcagtgttaaactcaagaaattgaggccttgagaaggggacccatgggcagatgctcaagagtaaagacattcagaaccaaggtgcagacaaaaccgtgcatccataagataacaatgtatacagacacatcccctgaaggccatacgtgcttcatgaacacttgggaactgggatgcctacacagaaagaagatggggaggaacaatcctaaatggaaaccaatgaagaaaacctgaaatcaatatggttatgttttctgtcttcaagtagaaaggggtcatgtccatccattcaaaagaatggctaagatgagattaatcttgcatttcccggatgcattttccccaagttggagtgtaagccagctctttggagctttagaactaagcatcatctcttcttccttgctgacatatgttctattgaacatcttttctcaaaatagacctgtttcgcccacattgaaaatctgtcaaggcaggtctctccccccttcctggtgatctccacaagtgttggaagggatgtcctggcagtcgtggacctgcccacttactgccaggtggtgccgattcaactgggcgcagagcccatatggcatctgtggcttgagacataagtatcatcagccacagtattccccaaattcttaaaaaccttctgctttctgagttaacattgggcttattgtcatctagtactgttgcttttattctagctgtatactcatatgtttgagtgttttgtttactgatacttcctcagtttttgtttctttcctgtacatcactgtaacagcagcacattctccacacattgaaagactcattgtctgtccttgagcatcatctctactgtcaaatgatagccctcgtacatgcatccactacattcatcattgtctcactatttatgttttgtaactctcattattattataggtcttcagtttctaacactttcaaattagcactgtcgttgaattaggcataattagatttaaaattttgctaaagtactccacaactaaggaagaacagggctccaagtggttaacattaactttggtgggggtatgataggagagtgttgacgaacctgtacttggagctagttttatttctatttaggctattactctctctttctccatgcttccctccctctctcccttcctccctctctctctctctctctgttcatatatatatatatatatatatatatatatatatatatatgtacacatatatacacacacacatatgtatacatatatacatacatatacacacatatgtatacatatatacatacatatatacatacatatacacacatatgtatacatatatacatacatatacacacacacacacatacacatacacacacatatatgtgcaataaagaactgcctgagactgggtaatttataaaggaaagggatttaattgactcatagttcagcatggctggggagacctcaggaaacttacaatcatagtagaaggtgaagggcatagtagaaagggcatagtagaaagcaaggcacctcctttacaaggtggcaagaaggagaatgagtgaggagggaagggggaagagccctttataaaaccatctgatctcatgattcactatcaggagaacagcatgggcaaaaccaccctcaagatccaattgcctccacctggtctctcccttgacacacggggattataattcaaaatgagatttgagtggggacagaaagcctaaccatatcaatgtgtgtgtataatttatttctggtagatgaacatgttcatcaaaatcaactatataatcacaatattaactgaaatatctgacttttaagaactttaaatattttagaggttgcctacggctgtacaagtaaataaattgatagagcacattcttttaaatataaaatgagaggaaatagtcttaattagattactacattttccccatggatgtgtcatagtacattctagaggaaaaaagtaattgattatatgaagattagaataggtatatttaacaagcaggtagtgtttgtggaaatgttctaagatgttagaaaaataagaataagatctactgtttcatagcacaatagggttgctatagtcagtaataacttaatggtacattttaaaataactaacagagtataattagaatgtttgtaatacaaagcacaaatgcttgaagggatagataacccattctccatgatgtgactatttcatattgaatgcttgtgttaaaacctctcttgtaccccatcaatatatacaccttcctcatgtaccccgttgacatatacacctaccatgtactcacaaagataaaaaacccattgaaagaaaaaacttaaaagaaaaatggaaatgctctaagagatgacgacaggtaatatacgtcttagtgcatttatgtatgtgtttatttttgcaagagatagacataactgtcagcccctggacacagctcagtggatagtgacttttgctaacacttaatggattccatatgttcaataaaaaatcattatgagaaagttcactgaaccttttatacaaactaaccatgcaaagctcaattcaaaaaggcacctaggaagtgaatgcaatacttgcatatttcctttgacatgaataaatacaaaggcattttattttaattgagttaaagcataatagtttctcttgcataaataattaaaatagaaagaaaaatagcatataaggagacttactgatatcaggcactgtcctaagtatattatatacactgaaatatctatcaaaacaagcctatgagagacgattattagatcaatttgagagaaaaattaactgaggcttacgtaggttaactcccataggttatactaatagtgatgcaataaaccaggagtttcacctaggcagtatgcccaaagcccatgtattttaatcattataatcagactcctacattacataccactgattttaatttggaaagataatttttttctagaaatgtttctcaatagtattttgttctaatacaaatgtgaacacctttaaaatcctaaaagtgttaaacaagttggggggtaataatctgacattctcccaggtaaggggatttcgaataaggtcttcctatggcatggcaacattaaagtcctcactaagcaacatgttatttaacttcatgacactgggaagagagtatttgccagctttagaaagcaaatgttaagaatctaaacattatcaaggggactattttgcttaattttgagctttcaacactaaagaagtatataaaggaacatgggtatacttcaatgattatgtaagggtccaggctaatcaaatcatcactgaggtggctattacacacaccaaacatataatcagaaaattgtggctcatgagaagtttaacttaagcccttcctattcaataggggatgtcttaggaccaggatgtttgatgatatccctgaaatcacaatgcctattaatgttaacagcctattaaaaaaaaaacctacacatatccttttatcgttattatttatttatttatttatttaattttttttttgagatgaagtctcgctctgtcgcccaggttggagtgcagtggcacgatctcggctcactgcaagctctgcatcccaggttcacgccattctcctgcctcagcctcccaagtagctgagactacaggtgcctgccaccatgcccagctaatttttttgtatttttagtagagacggggtttcactgtgttagccaggatggtctcgatctcctgacatcatgatccgcccgccttggcctcccaaagtgctgggattacaggcgtgagcctccgcacccagcctatatcattgttattactatcgttattactactattattccaatgttaatatggtgcccactgttttaaagtagaaatgctattatttaatcttcttgtgttcgtattcaataaagaaaaatataagtattatgacaaggcagtgatttggacaggatgtttcgaatgcaggcatgttgacatataactggacatgagccctgatatagtttggatatttgccgccactcaaatctcaagtggaaatataattcccaatgttggtggtggggcctggcgggaggtttttgggtcatggggacagatccctcatggttttgtattgtcctcagtgtagtgagtgagttttcatgagatctggtttttttttaaagtgtgtgggcatcaccttctgccatgagcaaaaactccctgaggcctccccaggagccaagcaaatgcctgtgccacacttcctgtacagcctgcagaaccatcagccaattaaactttttttcttgttgaaatataatgccaagtgttggacttggggcctggtgtgagatgtttgagtcacggaggtggatccctcacagcttgatgctgtcctcatgatagcagctgagttcttgagcgatctgttttgttttttttttttttaaatgtgtggcaacctccccctggcttctgctctggccatgtgacatgcttactcctgtttcatcttccactatgagtaaaagctcccggaggcctccccagaagctgagtagatgctggtgtcctgcttcctgtacaacctgcagaatcatgaatcgattaaagctctttttaaaaatacattacccagtctcggctatttcttcatagcaatacatgctaacacagacccaccctccccgtctgtccttgatactcttgtttttctgccgattttattcctattgtatctactctttgtttgatgttaagaaaatgatctttgcttcaaaaattcaaattataatcctgcaagctctttgatataagtgttcaatttaaattaaaaaggcaaaaccaaaataagactaagcataagaaaataatacactttcccttagttaccagagtgatatatttgaacattttaaatgctttcaaaaaatcaaatttctaaactgttacctctacttaatcccacagaggtgataaaattattggcaattgatgatcatgtggataaattgactgacaatttcattcatttattcattaatagctcctcattgatgtatgtatcccaaatgtctcctttccttctctcaaaggggcaagcaaaggaaatggaaactgtaacagtaaaagccatatactctaaggtggacattagaaagtctcttggtctacaggtcgtttttaatcctaaagacagaataatctacctatatagaaatcattaaacaaatagaaattttgccttataaatagtaggaaaatacatacctacatttatggcctgaaaaccagcatcagctatgttatagttgtccacatagaactaatataatgtactgggtagaaagtgaccatttttctccattttgacccttgtcatcactggaagaacatggattccattaaggttcccacattcattacccttctcctcacacagaaatgcaaacattgaaaagtttcttcgtggagagttctattttgttttgttctttttgcattaaaagttcaatactatttattcaagtttatcaagctgaatgaacaaatggcctattataattgcatttcatattttgggcccttaaatttcgaaatctacgtttccaaagagaaagttaaaaacaggggaaaatgctgctaaattatttgatgagcttcatatttgtgatgctctcattttagttacattaaggcaaaaagccaaaataaaatcccaaggcttggagtttgaaacaagtggtgaaagggaagggagcattgataagagaggcaggaaagatagatttaatggcattttttttgttttaaataatgcttaagaagaaaaattatgtttattacactcagtttatttccctgtggaagaacaaccttttcctctcctcagtctggaactcatactctttgccacatgacctgtgggaaattgacttgaacagatgttttggtttcacattaaatctacaaattattttgcgtaattccctagtgcccatctactataatttttatgatgtctctactctttgttttttacatactatgacaaaagagtcataagacatagtgcctagtcagtaattggctcactgaaatgcttagagtttatatatttgtaagaccacacaaaatttcaagcaggaacctttcagttatcacaatctttattaatactctcttgaaattgacactttttaggcttcatatgccaaaaaacatgagagtaataattgaccttatgctttaggacatgtttcttcttaaatacttcttattttaatattagtaacaattctactactaataatatctatggttcattgaatgctagtctacataggtgcatagatacctggatatagatgataaatagatgacagagaaagagaaagatagaaacagagaaatatttttactttgaatgaaatacattatctctcccatcctaataaccaccttccaagataagttcacatcttattattagagatgagaagatttagttttaacaatagtgtttgactgaacttgaaatacacaggtgtgtaaatattaaaacattaaaacattcctaaaatctttgcagataattagaaagagtctagcaaacattatctgtaataaaaacatatatatttaatttggaatgtgctttaattttgtggtattttgtgaccactctgttccttgtcccttgcctgtgattagtgaatatagagtgttcatttattgacacttttatccactatctctggaggacaaatgtgaagtagttgccaagactctactttaggcagtttcacatatcattaaaacaaaaatttacagattatgtatttccatgaaatatgacaataacaaattggaaggctgagggctaattttacacataattttgcaaatctgtttgttaagaatgagtatgcaattcatacattgacattctggtagttcatcagtttataaaactagtgaaatggaagaatgcattgaaatttaattgttggtatcttcacacttttgctgactatattaaaacagatacattgaactgagtggtcccgcctcctaataatttataacatcttcagtttctgccactaatatttatcattatcttatgaacaggtctgtgcattgaaataataataaaaacgataaggaaataaatagacataactattatttattcagtgtattattaagtgtatgatataatgccaggcatcctagatatatcatctcatttactcctcacaatgaacctattaagtagatgtccttgtgcctattttaaaaatgaggaagataaaacgtacagaaatttaacattttgcccaagattgcaaagcaaactaaatgcatgaacaaggatttgaactgtgtttttttttttcatctggaggcctccgttcccaagcatgcttttaaattttttttttctcttgacacatatcataaggtttcttctcatttttcacatcatatcaaccagtctctttgctgttcctggaacagcatattcacatctctgggcctcggctcttactagttccttatcctgactcatttctttagatagtagcatgtttcattccttgacttgatttaggtctctgctcagatgtcacactctcagcctcctctcttcaccactcttgctaaaatactgcttccctttttcctttaccctgatgatttttttcatcgtacttttaatctgatattttatcatatttattgggttctttgcctcccctgctaaaatgtaaattccacaacaaagggacgttgttttctttatggatggatacctggtacctgcaacaaaacctggcacaggctgattgactagtattggttgaataagagcaaaaatgaatgactactgagatttaccctaaaattttcaaatattttgatgtataaaaatagtctatgaatgtaaccaaactgtgtggacagaggctgatggggtctcaagtggtgtgtgtatgtgaagggtaagacattttagaagaagtacctatgctggattttgaaactctgaaaggacaaacgaatggagggaagaaacagtagactgcgggatacttgagaacgagaagaaacaaacaaacaaacaaaatgaatgaaagccactgtcagttcttggaacacagagttgggaaaatgtattatctatatctggagaaatactcaagtcaggggaaggagaacagatgactggcaatgaagggacctcaaagcaaggtctaattgagatttgagacaacagcatgcatccacttggagttcttacaaagaggaatactatgttcaactgactcgtacatttgtaatacgtccgttaaaaaaaccctattgctattggaaatgagtatggaaagctttcagaatggaagttttattccattgttggtaaggggtgcaataaattattcatgcataaccgcaactacaaggaaatgggcataaagaggtgaggtaagtaggaataagtgctagtgcatatataattactaaatggaaatggtttgacaagtctgatacaaaaaggctctctggaccccaatttcaaataaaagacctgaagtgatacatttattccttatcccttcagagtctccattttctataagcgagccccctccacaaacgcaccattaaacctgtacaatctatgacaacaatgggaatttatccaagatgtagacgtagaagtgatgggtcaaagtgatccacagttcacatcagataccattaagtgtttttatagctctttacctcctctagtataaggactcaaaaatacagcttgaatgatccagaaaattgaaggtatcaggctttagtgatacctaacaattagttggatgaggttctgcacttgaagggcacttggtttttcaggaaggaagattttttttcagtaatttttgtattcttactggggtgttccttacactgtattccatccctaagaaaatgctactttttcattatcagttgtattgtatcttgacatctaattggcaatacaccacatttctctataaattatctcgtttaaacagttactttcctagttaagtatatttaacaacttagattctgacagttttttaataaacgtattttggtatttttaattaaaatcagtagagtataaacaaatagaaacacactaaagacaattatgcattttaataaaacaaatgtgcaggtccggaaatgttcatagactcttgattttatttacctttagtattataccaaatgtgaccagtcatttttcaaatttgagcatggattatgttttttttctgcctatatcaaatagtataggggtccaaaacaggtttttagggagttattaagtctatagaaaattatgcttttaggaagtgttgtgcttatgccaagtgggagaagcataataataaaatacaaagtttacaaattatactgcctaggttatacaattactacataattgaaaataaaatttaactgctgtgtacatcatttatctatatcaaagttacctatgcttaatttgaaatcactgtaataatgctgataaatgaaagaattgaattgatttctacattaaaatgtacaattaaacctgctaaatatgcaactgtactttttatatgtgcctttattgtagtaaggatagaaattgttgattgtaaatgtaaaccttatgttctataaggaatgatttcttaaaaagggagtctattacaatcagtaatatcataaaattttaaagataatagatgtttttcatccagttcaaaatgcttcaccatgtgggctttttgatcctatctttaaaaacttttgtgtccatgagaagtataagttaggtaagttttctaagttaactgaaataaaaacacattgaatttcttaaaatcctagcaaaatagtgtaaaataacgtacctatagtcttctctggcacatctttatatgaataacgtgaatcatgtataaatatccttgaaatatgtatttcatttacattgcctcaggctaacttcctctttttttttttttccccctaatagagacaggctctcactgtgttgcccaggctggttttgaactcctgggctcaatcgataatcccaccttggcctccaaaaatgctgggattacaggtgtgagtcacatcacccgactttcaggctgccctcttgatcacacccacaattactgattttttttcaaatggaaatgtattttctaacataaagtataggttagacaaatgcacaccaaatgttaaattcccttctgtgtctagtcatctctgtaattatgaagagacaaagtttaataatatgaaagctgatgaagaaaaaataaccccataatttataaatgtgcattccccagagtgaaaatggctcttggtaacttcatttttaatttcaattatgtattttatataaggaaaaatcacaaaataggctgcttactgtagtgttgaaatatagtgtaatgatagaatgtaattttaaagaaatgtttaaataaataatttagaaaactaaaaatggcctactttttatgatgttaagtatatggaatgctgaattaagagagtaaatttttcttggcaaatagtagacacactagatataggtgaagtgaatgaatatgtagaaaatcagttccttaagaacggctcaatgatgatatttagaatctagtgataattgaaacttagtttaaaagtgaactaagataactaaaatattttcatgtgcttattcacataatcaaggcataggagttaagggtctcctgtcatcgacagccctagagaagttacgaaagacaaatatgagacttttaatgatatcagatattttggggcactgcactgtcatccttttaagcaaactagattctctctccaccacaagcaaaccctaagtgggagatgcaagtacaccttgttctttaaactctggatctttgtattcacaggacaacattcaataaggccacctgtccattgtaatggagatcatgaaataacctaagtttactttttgaagtaatttgggaaatgtagaaaaatatgttcccaggaattttcgtattgggtagaaatatatgcttttctgcaagtgcagtataaaagtatgaaaaataggatggagtaacaggaaaataagttttcttagttgggcagaccatctaggcatagaacctgagtaagtaaattcccccaataattaatcttaaggttcacttttcacatagaagttaagtcacataaagatacactcttgctcctctagctattaaaccaaggtccataatttttttttttacttagtttccactcccagggatatgaaatttagattcttgaccccaaatgaatcttaacacatggatgaaacacttcaaaaagtatagtttctttcctgtttcaccagtcacctgaccaaatcaccttatcaccccttaattcaaaattgattgtgctctctattctagacttcgagtgacccatattttttgccatttgtatttttctttaatttcctagcccactttaccggtcttctcattgtatgttcagaataaaagaaaaggaccacgagaagaatatcctttatggtactatatgaaaacgtggcatgaatatgacttgactaatcatacaaaaatcagtaacatcacactactgtccacagatattgggttagtcagatttcattagtttagtcaggtaatcgagaaacctgcttgaaattaagtgggaaggtgggcacaacgataatcaaattttataacatagcatactgaaggaaatctaaagctgacattaattggaaatgaatgagagtagtagatccaaatatctgcagtaccttgagcagcaggagatgaactgtaattgtcataggccctttaattacgcactgaggaacaactccaccaaaacatcactgctccagaataaaaacaaactataaaaggagagttgcaatgcctctttcttgatgaaagactttgggaagacttgggcaataaagaatactcataaattgtgagtttagtttcctgaagagtctttccccttctctcttgtctattcccacaccactgctagatttatcttcctaaaatagttttagaaacttgcacaattgaaaatacaaaattgacaatcagactaaaagaaggtgtaatagttaggtcacgcattcatggatcttagaatgggacatagtggtcaatgaatctaagaagctctcaaatgtagaattctcatctaagcatccctaacagatgacaagtcaattttggcttagacagtttcagctcattgctttgtgatgctcaaaatactatggagaatagctacaaggaagttatctcgtaaagtatgctgaaacattctttcctatacttctttttatcatttggtcctgtagtagtttactagatcaacacagaatgaatttccccctcaagaagtatatgaataagggaatgatacacatcagaaaaggtacatttcttcactttgttagctcttgttcactacttttagcacagctggcaaagctcttaatgtcatgcctctgtctactttcctattacagaggcattgttgttttttctcgcccactctcaagccacacataccactctccagtcctaaatatgcccttgacttttgtcactatgcctttgttccctctgtcagagatcttccatgttctaaatgtcttcaaagacttctcacccgttaaggttggttctaatgacatctccctgtgcaatctcctaattgcatctttgttggcacacacacatacgcacaaataatatatgctttgttcataaatcacattttattctgcttaaaatagttctttaaatcttgtccatgttcctctccctagttctgtaaaccttttgaaagtaggatctataccttaaggtcacctaattttttttctcttttttaaaaaaagactatatacctaaatcaaaggggggaattaaatgcacataggaaaatattgattttgtccattagacttctaaatctatacacaagaagctttcattattcacatatatccttaatcatattgtatatgtggggtatgtgtgtgtgtgtgtgtgagagagagagagagagagagagagagagagagagagagagagagagaagaggactgaggaaccaaaaagaaaataagtcaggagcataaggaggtattttcttcttttttttttttattatactttaagttttagggtacatgtgcacaacgtgcaggtttgttacatatgtatacatgtgccatgttggtgtcctgcacccattaactggtcatttagcattaagtatatctcctaatgctatccctccaccctccccccaccccacaacaggccccggtgtgtgatgttccccttcctgtgtccatgtgttctcattgttcaattcccacctatgagtgagaacatgcggtgtttggttttttgtccttgcaatagtttgctgagaacgatggtttccagattcatccatgtccctacaaagtattttccttttctacaaaaaaattctaattgacctgtgcacattattttcactttggagaagtgacttctcctcaagtaagccataacaagtgtttgccaaagctagaattagctaaccacttgctcatttgcttacatatccccgaggcaccatacaggacattgctgatactatggaaatgacctacagaagtttggacatttggtgaggaccatttttcactttttttcattcctttctctatgtgaaggaaatttaatagtattatgtattctttaataccttaactctttctctaatgtgtgagagaggggagggaagggaagggaagggaaggagaggggagggaagggaaggggaggggaggggaggggaggggaggagagagagatcaaaggacaaagaaaataaccagagatacaaggatgcaaagagaatttcctttttctacttccaaaatctagttattctgtgcaaaaacgttaagaacgaactttggaagaaaactatgcatggtgaaaatgctgctgtttaaaaactacaacaaaacagcccatcatagagtagaagaaacaccggcctgggaggacaagtgcctgtgttctatcacagagctaatgttaacaagctgctcattgacgaaaatctcgtcccttatatcagactcaatctcctcattcataagatgagaaatttgcactagattatcactgaaatttgctccacctctaaaatgactagggttccatattctggtaaattaaacagagtaatgttttaaattaaagatattatcacaggtgtgtaatcttgcctgttgagcataaattaagaatattttcaaaacgatgtgacattcaatttatagtaacagattcaaaaagcatatttaaaaataaattatagctagataggagaaataagttctagtgctctatacgactgaatggtgactatagttagcaataatatagaagtttcaaatggctagaaggagaacgttgaatgttcccaacacaaataaatgaccaatgtttgagataatggatatgctaattaccctgatctgatcactatacattacatatataaaaacatcactaggttctccatgaatatgtacaattattatttgtcaattaaaaaaattcttcaaaagtaaacaatgtaaaatagtagacgtgatgtgaggtataaggagaacttcccaatcaattttggaacataaaacttcatttctgaggcaaaggaagaacttgacattttatataacttctttgccagaatccagtggctctactatttttctgaagaatgcataaaatcacagtatcatgatactttggaatttaggaggctgctatactgagtttagtcctgtctgtttgtatctaacaaagaaatctttctttttctccaaccctcagtttctccatcttggaaataagaaagttagatgtaatgataacatgaatgtccttacctcttaatctttcagttttatgtgatcatatgagtatcttctctctgatcaagcagtctgcttagtgatttgataaattaaatgataaactttcatttgctttgaagtgttttttattttgtttttgtcactataaaaataattaatttttgagtatttacagcattgtccttccaactgctaaagaaagtcatgtccttgccattttcttcctcaaagacttagaaaaagaaggacaaactaagcccaaagttagcagagggaaggaaatattaagattagatcagaaaaaagccaaaattgaaatagaaaacaatagaaaaatcaacaaagctaagagtttttttaaaaacaaatcaataaaattgacaaatctttaggtagattaagtaaaaaaaaaaaaaaaaaaaggaaaattcaaataagtaaaatcagaaatgaaagaggagacattacaactggtatccaaaaagaatgcaaatgattataagacactgctgtaaacaactgtatgttaacctagaaaaaaatgaacaaattccttgaaacatgcaatctaccaatattgaatcttgaagaaatagaaaatctgagtaggccgaaactagtaaggagattgaatcagtagtccaaaaccttccaacaaagaaaagcccaggaccaaatgtcatcactggtgaaatctaatgaacagttaaagaagaattaacaccaatccttctcaaattcttcagaaaaattaaagagaagagaacacttccaagctcattctacaaggggcatcagtatcctgatatcaaagtcaataaaagacactaggagaaaagtacagaacaataccgctgataaatatagaagcaaaataactcattaaaatactagcaaactgaactcaacagtatattgaaaggattatacacgagagccatataggatttattcttggaatgcaaaaatggttcaatttatgaaaactaatcagtgtgatacacaacattaacagaacaaaggctaaaaatctatggtcatctcaatagctgcagaaaaagcgcttaacaagtttcaacactttcatgataaaaacacacaacaaactaggaatagaacgaaattaccgcaacataataaaaaccgtatatgaaaaacccacagtgaatatcacatttaatggcaaaagactgaaaatcttttcccttaagatcagaaacaagacaagaatgcacacttttgccacttcttttcaaaatcgtaccagaagtactagccagaacaattagataagaaagagaaataaaatacatcaaatttggaaaggaagatgtaaaattatatctgtttgcaaattagatgatctgatacgtagaaaatcttaagagtgacgccacacagagacatggttagaaccaataaacaaattcagcaaagttgcaggatacaaagtcatcattcaacagttgcgtttctatacgctagcaacataaaaacaggaaatttagaaaacaatctcatttacaatagcaataaaaagaataaataacttagtaaatacccaaccaagaaggtaaaagatgtgtgtgctgaaagctatgaaatattgttgaaagaaattgaagatgacaaaaataaatggaaatacatctgatgtgtcatttaaaagtctatatatccaaaccatctacagatacagtgtaattcctatcataatcccaatcgcattttttacagaaataaggtaaatttcctaaaattcatatgaaaccacaaacgactccaaatagccaaaacagtcttgaggaagaagaataaactggaggcatcacacttgctagtttcaaaatgaattaccaaagctacctcagtcaagagcgcacgatagtgtcataaaggcagacatatagaccaatggaacagaatagagatcccagaaataaacctagcatcaccttcaataggggtgccaagaatacacaactgggaaaggatatcctcttcaaccaatggtgctgggaaaactggatatacacattgcaaagaatggaattggacctttaacttaaactatacataaaaatcaactcaaaatgaaatggagtaaagacttaaaaataagatctgaaactatgaaactcatagaagaaaacataagggaaaaatttcctgacattggtcttcacaataattttttttggatatgacgctaaaaggacagccaacaaaaacaaaactagataagcagaaatatatcaaactaaaaagcttctacaaagcaagggaaacaatcaacagaattaaaagcaacctatagaatgagagaaaaggtttgcaaaccatatatctgataaggtgtcaatatctaaaatacatgaggaacgtaataacaacaacaacaaaaattcgaacaacccaatttttaaagtgaacaaaggaattgaatagatatttctccaaagaagacattaaaatgaccaacagttatatgaaaagatgttcaacatcactaactaccagggaaatgcaaatcaaatccacaatgatatactacctcacggattaggataaccattattaaaaaaaaaaaaaaaaaaagcccaagatcattacatgtgttggtgaaggtgtaggaaaattggagatgtagactgctggtggaaatataaaattgtgcagcttttgtggaaaacaatatggagtttcctcaaaaaaataaaaaatataactaccataagatctagcaatcccgcatctggatatttatctaaacgaattcaatttaggatcttgaagagatatctgcattcccatgtttattgtagcatttttacagtagccaagaggtgtgaacaaactaaatgtctattgacaggggaatgtataaagctatgttatatacatacaatggaatatcattctgccacaaaaaggaaatcttaccatatgctacaatgtggatgaatcttgtagccattttgctaaataaaataagcaagtcgtaaaaggacaaatactgcacgcatccacttacatgaggtatctaaagtagtcaaaattatagaaacagaaagtacaatggtggttgctaagggctggaggagggaagaaatggtgagatgctgtgcaatgggtatagactatcaggcatgtagggttaaaaaaattataaagatctgctatgcaacattttgcttatatttaacaatactgtattgtgcacttaaaatttattaagagggtggatttcattaaaaaaataaaaacaagtgcttcattaagaaaaaaacatctttttcaacacatacaattctttgttaatgaacttaatcattgaatgccaactggttgggaaatggtatacctgacaacatagaaagccatcagacagctaacatggtatttgcaacttctcgtgagggtgggagcaccataaacacatatatgaagagataataaaagtccaaggcaacaatataagatgtagcataagtgacctcgtaatgaactgaaatagatattaagttgatattaaatgttgtgtatcaacggcagtgtgagatcattgtgaactagaatagtgtagcatatcttttggactaaggtagattattccaggctttaaattccgaaatatttagagagtaagaaggacatagagagaccattcagacaacagttgcaacggaagtagacttgaaggccagaaagagctcagcatgcacagggataaaacaggaagagcccagtgctaaggattcactcaggggaagggtgggtgataatactggatgcttaagttggtataagatagtaagatacctgaaatatgaatctgatgttttagttttttaaagaattttacaaaacagatttttaaatagctgtagagattcaaaagagaaacgaagcagttgtacccaaaagtaggataataaagatctcttgattgtgttaaattataaatgcatactccatccatagggtgatgccaaagaaggaggaaacaagtagtttgttatttgtcttcaatttatgctatgcttcttctctgtttgaagaagttgacctgtctgctcgaaagccatatccagcagacccaccgattacttgcacagtgacagaatttaagggtcaattatattcatgaactaatttatttccactgagtttactgatgaccctagaaaatttaagcggtgacacaggactgtaaattctttgttgcattataaagctccttcaagaaattaaaatgcttaagtgaaaataatgatctatccaactttgagtggtttccctacactttttagtgatcactttctggtaagagacctagaaaaaaactgctgaatgaatcctcaatttgtcaattttttggaaaaccaataccttctacagctattgaaaattcagagggcagtttgcaagaaacttaatctatatcatccttcctgcaaccttaccacagccatgattttatcttcatttaaagcacgagattgaaagatgcattgtgagagaagttccggtttgctacttccttcattgttatttttaatctttgagatatacaataaagcatcattaacctgaaagaaagaacacccctccagaacacacagtaatcaatggcaaagttaattggaattgagttcttttaacaattccaccttagcaattctacaatgttcctagtgatagacagttttaatcaaagcttggagtatttgaaaaagagacaaataatgtaaggaaggagataatttgtgactaaaacctagtctttccactaaggatttccttttctttaaagtttcaggtttggagctgaaacactttttgagtagagaagacacaggatgggacagtggttgaaaagaagttggtctgggtgcaaatcccaactgcagcatgttagctgagccatcctggacaactcacttagcctctctgtgctccagcttctttgcctggaaaatgggaacgataataaaacgcactttggcctggcacatagtaagccttcaataaaactatcactatcatttttatgaagcaagataaagcattcttcttgaaccacttctctacattttttttctgaaaggttagagctcaatgagaaccataaccccaggccagggcagagtaaagaaagatatacaattcttcagatctaagcagttgtttatggatacctcaaaatgattgtaatattaccaacatacctaaaagaaaagacaggtgggtcaggctagtacatgtttacttcctacactgaaagcattttgattgatgctattctgactcttccaaattttaatggctcctgttaaccaatttcacctgcacactgggctcgtattcctcatctcagctggtaagaaattaaagtgtctcagtacgatgacaagaaactactgagcaggccattcatcgttctgaaaacagtatgaaacagctatcatcatacctctataaattaaaatgttattttctttctacagttgtgctctgactacaagcatatcggccattcctggtggggtccagttcattatttcagtagacgtaaataatttttagcacaggtatttgaaattagaaggcgattcagcattggaattgagaattgtccacaccactgcttataaccttggaattaagaaatgtggaggtgccattgttccctggggtcatttccatcattctgtaataggtcttttgtttttgttgggactgttgtatttgccacctttggtcaaatgaatctgaaacaattctatagctagagcaacaccacgaaagattgttttgtcactaaaatgatgagctagaaaggaaacgcataggaaaaacatgctcagccttcctatagctaagaaaccaatgtacggaggccagaagagtagttcaagttcttcagaagcacatgaactctttattctaataaattacagagtccacatgtgggagatgcttcactatttagtgaaatcatttcacggaataatatagatcaatgtttctcatgctgatttctccaggtcttagaaatctgaggtgtcagttttaaaatctcctggaaaatatgtgtacacatattcagggtcattcagctcaactgaaactgatagctgattacagtgttcctgctttgttgatatttataaggtctggcttcgtatcaagcagttatgtaaagtgtaaagaattggtgagaatgaacattatgcaccctccatgaaagaagaccaaatgacaaccaattgtatgaagaaatgttaaacacaattagaatggaagaaaacaagtagatgaggagttagtgaatgctacctaagaatacagatattaacctagaaatatgttcttgaataattacgtgacaagagctagacacagaataaatatatcatataatttcatttctattttaaaaggaaagtttatataaaattctatatatgttatatatattaaaacacgttcatatgaatacagataaatgtcttgatgtgaatggatgattcacatgaacacttaagaaagttaaatggggcaaggcagaaatgtatcagctctttatacaatactatttttaatttgttttaatgagcatgtgttacttttgtatatcgggaatacgtttcttaaaaagtataagtaaaaaggattttagaataaatggaagttttaaaacaagcagcttgccatatgaagaattcatactagtctttttggatgaatgttttaaataggttaacacgctcagtaaaatttaatctgcacaaatggctttgtcttacacagagaggatctatgtggaaaacagaaccaaaagccagtccaaacaagtaaaacagaaactgaatgtagagttggaactgatattcaattttggattagaaactgattattgaaaggaaaaaaaaacacagtaatttcagatctgctgtttcagtaaacctgacactaatctgagttttttaaaaaaattaattctgacaaagcttgagataatgttttaatagtgagtcactacaaagtaactattaagtattcaacattcaattaagtcaattcagcttttgatgtttcagccaggtaaatgctcaacatgtgtggatataacacatgttatacttttccatttgtgcagaattttctactcaaataatgttttaagtatgtctaacacacacacacacacacacacacacatgattatatatccatatccttcaacaaaatctgaatatgccttcactataaatcttttgattaggttagaaaagacaatctatcctttggagtgatcaattgcctatgagttttgtccccctcaactgctgcttagtccataaacggaacctcagaagttctgctggaagctacagttgaagtctttctataatgttctcgttgctaagactttagagctagccatagaaacaaactgcaaatgttatttatgctttatgtagtaaaatgataacctgaatataagactgggtctcgattatttgtttcatttatttccacactccaaaaagtctagatccacaaaatgcaaacctaggattccacgcacaaaagggtgcaaacacgaacttttatgattctcatatctttcaaatatacttatgaatagtttattactatgggacaggtatggataagtgtcgatttctttactttttattattttttgtaggtacatagtatgtatatatatttgtgggttacttattgagaatccattcaacgagtatacaaagatcgcggatattaaaactgaaaagaaagacaacctggaagttaaaatgtttgacattaagatttactaaacagaaagtttgcaaaatttcacaaactatataagttcatctgatatgatggatgcttccaattgtagaatacagaaattatattcttgagtttacattttaaacttgtgagatgtttggactgaatatataaatagaaatgacttaaaaattttcatgaatattttcagtggatactattacaaagctcaaagtggaggttaaaagttttgactcattcgatttattctcaacgaatgaattatctaatatttcaatgtatatgagataaacatgtttatattagaatgtcaccaattgactctttaatatataaagccttaattatgtttaatctataaaaccactaatgttagagactattcatcacatattcactataagataaacactatggagaaattatgcataaatgtgttacattaaaatactattaaaaagacaatttctatgtgtgtgtgcatgtgtgaagaatcattcgtttctctatccacttgactacttgtcatttctctgttatatctaagtgtaaaatgcagacataccagaatttttgcatgctgggtttctgggctttctaggtgataaaagtgcctaattattccaaactgttagatcattaatcctagccacaaaaacatctacattaatttaaaccttggcaaacgttaaacaagtaaattacgaaagtatgagccatcatgtcctacttctcttccattgtttctcagcatcttaaaggattttatttacaaaaacttagtaatcccttaaatacatttcttcagtatatctgaatttcctgtttgttgtgtgtattgtatgtgtctgtctgtatgcatgcatgcccatgtgtgtgggtatatggtgagctaaagaggcaaacagtatatacattagctaactacaagttttctacccaaattttcccacaggccacactcaacccattcttaaaatgttgcttaggcattcatcttctccttcaggataatgggggaaaatgcttatgctttttatttgcttcttgtagataatgaaaattttattattcaccctagcatgctatcgatgcttcagctgatcctttaaacatctggcctactgtttaaaatgcatggagtgaactgatgtcagcccgtgctgataatcagaggaccttcaattaagtacctacgaagcaaccaatgataaaagagaaaagacagtgcaagtttgccaaagaattctttcatagtctgattctcaaaagcaattagaatcacttcttttggccttggaattaatgaattttcattaaaatttaaatttcaaatgattccaaggatatcaaacttgagaagttgagctgattgtctacgtaataaatcacaccacaggaacatgtcaaaaagactaatgcaagttctttgccgtccaaagttttgtttctccttgtcagtgctatgtgaacatatataattgctttcttttcctggaagcagcttacccaaagacctaccattattacactccgtatttctctctgtttagaatttttgaaatgataactccaagattaattgaaactagttcaagtctacaaaacaagtttgctctcataattgaatgtgatatgatttttataaattgctgcagttacattcttcacactgtaatttgcttaaatgaggaaataaagttgaacattctaatatcaacatatcctgtatttgaaagtgacatttaacttaataacacagacattgtctttacttgacagaaaacaaaatacattggatgtttgtgtatgtgtaaagtaagtgttgtattttggactgtacagaagtataaccatgaaaagtgctaaacatctttggccatagaaagcaacacgggtgttttgaaatggtaataaaattgagcaataaagcagaaaaataatattcatataaaagtggtcttgtctgtggacgttaaatattttaatcttgaattaaaacagcacaacacgtaagtaataggcacattttgttcactctttaactcattctgacaaaagtatgtgcatgttttcaataacaaatttcacagtacctctttctttcctcgacagtgaatcttctttgtcaggaaaaaaaatctcaacagtctaaagaagaattttcttaaacatgacatatccatatcaagcagccatgaaggaatgtttctagttcttactgtaatatttttcttgccatgtccctcttcacaggtgtactttgaatcagattgattaacttatcagtggtttaattgttcaatatttgttccatgtattaatattttataaaggattttgaacctggggcaaaacctctgcactaaatttcccccatccatcgatcttttccaactcagcatttcaacagaacttaaatcacaggggtgctggcttataaataaatgtataacaataaataaaaatagatgattgtggctttaagatatgttcagagactggaagaaagagcagaagtccccaactgaccatcgaactgttctaatgtccattttatttgccccacatagtgtttaaatatttcagtatatagtcagcttggaacctcttgcatagatagcccttactacttcatgcttttctgttacctgactacccatgtgtacattttgttttgcaacacctgcattagatgctgacatgttgattatattgtattatactgacactgcatgcctagcctcatctcgtccctactttcacagctgagatctagagccctgttgcaaaaacattttaacctctgtagagagcagggcgtttttgtcttccgtttttacttgtaggtatcattaagtcccctatatatttgggtgctgaagagataataataatgaacacacttacgaaataaataaatcagctcatcatatggtgactggaattacttctgtgcgcacaaactaatgctaacatttttcggatgcacaaaacatgtcagtacatagttaccaacgatggatggatagaaatattgttttagaaagtctgagttttaatataaaaatggatgagagaaggaagttcctaaattcatacaaatcacctatagtggaaatggggatatgtagaaataaaataaattaagcttaatatttagtaatacagttaaaagcaattcaatatataacccatggattgggatgatttttcagtctactgcttacaatttcagtattaacatgctcttctcacttaaaacattagaaaaataggttaaaaattttcagacacatggacaaagaatgtttttatctttctgacagattatcagaatatgtaattattagttcaataaataaagaagtgactggtaacaaaaatgcaaaagaattcacactgtgatcaaagcagaataggatctccgacatgacttgatacaaagaatacacttccaattcacccaatttttatttttatgtataatacattagatacttttagtgaccacgaatatttatatgacatctttttttttcaacttttaagatccagagggtacatgttcaggtttgttacctggatatatggcgtgatgctgaggtttgggatacaaatgatcccattaaccaggtagtaagcatagtacacaataggcagcttttcaacccttgtctccccctttcctttccccttctattagtccctagtttctactgttgccatcttcaattctataagtacctaacatttagctccaactcataactgagtacatatagtatttggttttctgttcttatgttaatttgcttaggataatggcctctagctgcatctatgttgctgcaaaggatatgattttcttcttttcgtggctgtatagtattttatggtgtatgtgtacaacatttactttatccaatccaacgttgacggacacctatgttgatcccattactttgctattgtgcatagtgctgtgacaaacatgtgagtgcatgtgtctttttggtagaaccatttgttttcttttggatatctactcagtaatgggattgatgggtcaaatgatagttctattttaagttctttgagaaatgtccaaactgctttctacagtggctgaactaattaacattcccaacaacagtgtataagcatccccttgtctctgcggccttgccagcattgggtgtcttttgactttttaacaaagccagtctgacgggtgtgagatggtatctccttgcggttttgatttgcatttctctgatgatgagtgatgtgacgcatttttcatgtttattggctgcgtgtatatcttcttttgagaaatgtctgttcatgtcttttgcccattttttaaatgatgttttatgatttttgtttgttcaattgtttaggttcctcatagattctggatattacaccaccgtcagatgcataacttgcaaaagttttctcccatttggtgtttgtctgtttactctgttgatcatttattttgccatgcagaagctctttattttagtaagtccttgcttgtcattttttttttttttttttttttgcaattgcttttaaggacttagtcaaaaattctttcccaagccaatgtccagaatggtatttcccagattttattctaggattcttatagcttgaagtcttacatttaaatctttaatccatttcccaatgcttatttttttgttgactttgtcgacgaacagttggctgtagctgtgcagttttatttatgtgttctctattctgttctattggtctatgtgtacatgacatcttggtaggatttcaaacctgttcaatgccctaaaaaaatataacttttaagtgatttgaaaaaaactgcctgctaaatctaaacttggaaactgcctacttaattctataatgagaagggtaatctcagcataaatttcaaaagttaggctaaactccatatctacttgacaagtaaccatgagcttaaatataatctgagatcacccaccataatatggaagtgaggtaggtgagattggatggtttgggagtagagatacaatgttataaattccgaattggaacatattgacctgacaactgggtagaatatttgcaatcaatattgttcagagacattttagtcatttggcccttctgtaacagagtcatagcccaatccttatcatgaaatacctgggacaaagtatctgaaatgttaaaagtttgggggacgtaattatggtttgtggtggaatcgtaggcatgtatgtaaaatcatggctgtccttatatttgaaattctatttacttccttttggtatgatggcattgaaaagaagaaatgataagtgtttcagatggtggatatcccaattaccctgatttgatcattacacattatacgcttgtatcaaaatatcactagaatcttagaaatatgtacaatctctatgtatcaacacaaaaataaaataaaagctaaatctaaatatgtttctttagaaaaaaggaagaatgtcagatttttaaaaggtaataataattattttataggtaaaaatatttttctcatatacataattatggtagaattgagtgttgaatacaataaaatattctaatagcaatagatttgtgggcactgtaactttctcgaagcagcagagaaagttctgtaagtctccaaccaagttttatctatgttatgtaagggttttgaatgcttttctataacatagtttgatcttttttcatttgaagcagtaaaagaaatttcaatgaagcattttaagtatggtgatagattaatgactgcatacaatttcactcatttaattttatttcaccaaattaggcttcaaatcctccagaccatctgtgaatatctggttgacttgtcagagtgcattttgcctgagttcaggggcgctgtgaatttctcactccaatttaaatttaggacctctgaacactgttcttctatatttgacatctgatgggaagacttggataagcaaaaacacattcattacctgcattccagaaattaaaccatcagcaacgtgttgctacattttcaccctaaattgacaaggaggacattataccacgatggaaaaaacacatgagcaaataggctaattaggtgctattggtttagattatctgtcagcagcaggactgtaggtagccacagggagtacaggcaggggaggaaagcaggcttgatctagattcaagcatgaaaccagcactctagaacatgatgggtgtaatctggagcagataaacagaacctgtttcatgatagcatttttgatgattcaggccaatcggatggctaggaagcaggcgctctccccaccccgctcaaactgctgaggaaggtgaaccatgcagttcatcagagggctacaaagaggtatcaacacttcagttttccatatgggcatctggggctcacaaaaccaaacagatttttggtatcaaaaatagtattgcagcctctgtggaaaccacccatggggtttctcatctatgtaacactgacatagtagaaactcaggctgcctagagcacattcagagaacaagtgaatgagtgcagtctacaaagtaagtctctgtcacttacatcatgcttcctgagaatatcacttgcaattgtgaattatgctgctataaacatgtgtgtgcaagtatcaacccaaatgcccatcaatcgacaagtagataaagaaactgcggtatatatacatatgtatgtacgtgtgtctatatatatatatatgaatactactcagccataaaaaggaatgaattaacagcatttgcaatgacctggatgcgattggagactatcattgtaagtgaagtaactcaggaatggaaaaccaaacagcatatgttctcactgatacgtgggagctaagctatgaggatgcaaaggcataagaatgatacaatgggctttggagacttggggggtagaaaaggggtgccgagggacaaaagataacatatatggtgcagtgtatactactcgtgtgatgggtgcaccaggatctcacaaattaccactaaagaacttactcattgcaatagtttgctgagaatgatggtttccagcttcatccatgtccctacaaaggacgtgaactcatccttttttatggctgcacagtattccatggtgtatatgtgccacattttcttaatccagtctatcattgtcggacatttgggttggttccaagtctttgctattgtgaatagtgccgcaataaacatacatgtgcatgtgtctttacagcagcatgatttataatcctttgggtatatacccagtaatgggatggctgggtcaaatggtaattctagttctagatgcctgaggaatcgccacactgacttccacaatggttgaactagtttacagtcccaccaacagtgtaaaagtgttcctgtttctccacatcctcaccagcacctgttgtttcctgatttttaatgatcgccattctaactggcgtgagatggtacctcgtggttttctcagcaaactatcgcaaggacaaaaaaccaaacaccgcatgttctcgctcataggtgggaattgaacaatgagaacacatggacacaggaaggggaacatcacacaccggggcctgttgtggggtggggggaggggggagggatagcattaggagatatacctaatgctaaatgacgagttaatgggtgcagcacaccaacatggcacatgtatacatacgtaacaaacctgcacgttgtgcacatgtaccctaaaacttaaagtagaataaaaaaaaaatctcagaaatatcaaaaaaaagaacttactcatgtaaccaaataccacctgtaccccaataatttacagaaaaataaaataataaaaactaaaataaaaaagaatatcatttgctaggagtaaaaaataaaacttcatcttgaagatcataacaaccctagatgagaaagcaaatatattacctgatctttttattttccatcctcattttctcttcaatgatatgtatgaagagaaatattaatgttagaaaggtaatgcaacgtgttagtaattgctctggaattgatttctctattctgttggcatttatcagaattatttaaatttcaaagcacagtctaagaattccatgagataaatcttattgtaaatgaattatattaccatgggcttgctcattatttgtgaaagtgactttatctgcctggcttattattaaatatagtttatgaacaaggtggcacatttccttctgtttgatttttgtaaagaactctgtatcttgagcggttgggtgctgatatacgtgccacgatatgtaatattaaaaaccctttgctctccaatgacattcttatcatttgaagtcatttcttaatgtttctacattatttttaaaacactgctcttttgagattttaaaattgttatttatattgcaatattttatataaattaatttactccttaggaggaaactatatagtgaacaaagattttttatttaaccttttcaaaaataatatcttctatttgggaaaaaaaaaaatgctttacaaaagaggttccaaaacccagaggggcccacagtcattgtgttctttcttgactaacgaattccttgagtgcagtttcaagtacagattgtagtatctatcaatgtcttacccaattttccctgtcagtgtttcaaatatattttaattcctgtaaaataatctgggatgtggtaacaaattatcatatatacattaagaaaatttggttcaggacaggtccactgataaagtttcctggtgtgcccgatattctagtaattccttaatagaaacctaagagaaattagctcttttttgatcatcttaggtagcctggggaaaaaaaatcactccaggtacagcatcctttcctattttctcatttcctttaacatctagttttattttcttaatgctttgtcattttgttagtattttcttaatttttttttagtgtttaatactcggcaaaggacagacatagcctgcgatgcaggcagggctgcttctcttaatgttcttttgacagtaaagattcaaaattagcccattatcaaccaacaaataaaggagagggttggaaataagtgtaatggttccggccaaaaataaacacaaggccagtctgctaaattcgtatgttgcaaaaacgtacttactacttcacttagcctttaagaaagacatgggatgaattgggatttttaaagtaagaaggggaaaaaaagcaacactcttagctcctttatccagtactcctgactctgcaaggtagattgtttcctcctctaattggcaaaatgctgcaggttttcagtccctcggtgaaagtgacttaggacggggcattaattctttcagttcactagggcgtcatttggcaaattactatatgtgagcaataaatcaaagagttcgaagatgccttgagaaattctccaggattattctcttgccttctggtaaattagaaacatactacattcaataacaagagtatacatattttatattataaacattatggctaaaaaatcatggaagaactattattattttacaaccccctctttttaaatgttttcctaaacatacatggtatgtatgtatatttcaaactgtcaaaaatccctggattgcaagtaaaattcaactatcccacttgcaaaatgaatgggttaattgttcttactttagactcataagttttcaaagaataatttaaactgttaaatatttaaaacaaatatactttatttggtgacttaatagataagagaatagaattagttgtgaacatttatactaatcaaaataatgaactactgtcattttgaattgacacctatataaattctgatttaaacatatttttacatctcagaagaaagagcatagcgttaagtataagaacccatttcaaccatagattggcatagcaattatctgatcttataaggttaaaaatatgagaacattttcataatgatattaaagtattaattagtaaaatagttgctcgattatattccataaaaatagatagacaaagaaaattttaagataaattcctatgtagtaggtaaatacttttccctcaaataagggaatacattaaggagatgaaaaattctcaaactttttcattttataaataagaaaaaaataatcaaccatataaaaaccacatgacatcaaaagctatagttctaaatgctagccatagaaatgcatgattatattatgatactatttatctgttcataaacatgacctgcctccccagtgcaattttaggaccaatgaaaaggagatcctacatccttttaaatttccccgaaccctagtgcatgggaacaatatacagtattttctcagaataaaaatcaggatgatgaagaaacggcgtttactatgcaagggctgaatacaaagggagattagtggactgtttggaaaaagagaatgattattactgtttactttaagacataaagtcagaaactatagcctgtgtgacaactcgcatttgctgcctgtgtgcgtatggcacacaagctaagaatgggatttacatattaaatggttggggagaaatcaaaagaataatacaactttgcaacacataaaaattatacgatatccaaatttctctgtgcgtaaagtttgctaggaacaaaaccatgctcattcaggtatgtattgtctgctttcatactacaacagcgtagttgagtaattgcgacaaagacgacaagcctaaaatatttactaactagcccttcaaagaaaaaaggcttctgactcctgctttaggagaaagcacgtacaaggaggtaaaaataaacttttttttttttaattgcaatcagattccagatggaccctaagagctcagttacggaagtggaaggggaaaaacagcagcagcagcagcaacaacaacaacgacaacaacaacaacgacaacaacaaaccgaagaggaaaagagagctgagtggaaaaagtctttgaaaatttagtcctaaaacttatatttacattctcatgctctcctgaagtcacagaaagaggttcggaacttctgctttaagaggacatttgaatcgactggagaggaacaaagcattgaagagagaggaagtgaactcctcagataaagctctaatatgagaaacatagttccagagagaagttaatgttacttcatttttctgtctcatttccttcaagctcaaagcatgagtaagtgataatggtaagtaaatatgtattctctctgccatcctaaaaacagaaggagggggaccacttgtaaaattaaacactggctgtaaaaataatttatccatatgtaggatttttttcagttggagaaagcacccaagcctacagagtgcgtgcctaggttctgcaataacaatgcaatagaaacagtcacaattaacatacaggcacacaaacacagaaacacattttcgtgctttcactatagttacttatgggaaaaaatcaaataaaatgagggcattggaaggcaaacaaaacatgcagatacttattttttgacaaaactttaatgtgaagttattacaactgtctgaaaatttaactctccaacaaggtctttcttgtgaaaccgttgtttatcttgcaagttcctacagattctcaattctgtacccataattttcctatcccttgaggcctggtaaagttttcatggaaaaaaatgaatgtttttgagattctacatttaatctcttaattattctaaggcaataacatctttccagtgttacagatttcatgccaaaaaaaaaaaagtttatttagggatgcgcgcagcagctgacgcctgtaatctcagcactttgggaggccgagtagggcagactgcttgagaccaggagttcgagaccagcctgggcaacatggtgaaaccccgtctccactaaagatacaaaaattagccaggcgtggtggcagacacttataatcccagctactggaagacagaggcaggagaatcatttgagcccacgatggggaggttgcagtgagctgtgaccatgccattgcactgcactccagcctgggtgacagaacgagactctgtctcaaaaaaaaaaaaaaaaaaaaaaaaaaaaaaaaaaagagagagagagagagagagaagttatttagaactaacagtatgcaaggcactgtgctggctgctaatgggagacacaaaggaatgcaaagtcatgaccctccagaggattataacctcagcggaaagacagacaggtgtacaagcagctatgatacaaggcaaatggaggtaatgctttaaaagagctagacaggggaaggagatgttacctctagtgggaaattttagatgacttcatgacaatgttgtgctctggccataaaggaaacataagacttctttttttctttctttcttttttttttttttgagacagagtctcgctctgtcacccaggctggagtggagtgtcgtgatctcagctcactgcaagctccacctcccgggttcacaccattttcctgcctcagcctcccgagtagctgggactacaggcgcctgccagcacgcccggctaattttttatatttttagtagagatggggtttcaccgtgttagccaggatggtctcgatctcttgaccatgtgatccgcccgcctcaggctcccaaagtgctgggattacaggcgtgagccaccctgcccggcccataagatttctttaataagagatgcagcaaagaacattctaggaagacattattacattatagaggcatgagagggtatagtcttgtctgcctcactctcagattcataaaccatgggaggggcctaggaatctgcattattaacaagctccctaggagattctgatggaggggttctgcaaactgcactctaagactgatatagaatatctaccaagaaatagagtagggaagagcaggaacaaggtatagtgtgaaagctataggcttgatgataataaaatgagaaagcaagtctaagcttgtggcaaagagtcaatgtaattttcagtgtaaggcaatgagtgccttgctatgacaatgttatatatttacaattaggtgaaatagatccatttgcataaaattcaaaaactggcaaaattaatctatggtattagaaatcacgataatgcttatccatgggggtagcacggagagactgaaaaggggcagaagggggcctctgaggtatcatcaaggttctgtttttaatctaagtgctggttaaagggatgtgttcagtttgtgcaaattcatctagctgcacctttatattaggcatgcttttctactgaagtatattatacttcagtaagaagttataaaaattaggctgagtaggtgtatttcaactaaaagaaaacatcctataattgttatcttattaatctcagaaaatttcataataacttaatacctctttcaattctctgaaagttatataaatgtgataaaatagaatataagaggaatgttctaaaacatttttcagatcattctaatggggaaaataacttcttaaagcttccttgctaacacttaaatcccatcagattgaaatttcttattctaaagttaccatccttgagtctattatttatcctcactgtctcagcttgctgtgccccttcacagtaaaacttcttgaaaaagttgtctataatctttgtatctattttcccaccttatattatttactcagcctactcctctggaccttccatatccatcattctgttcaaattgctcttgtccagatcaccaaaaaattatatgttgccaaatccaatagtcacttatcttttcattatactgagcccctcataacatgctggttattaattactccctcccttcaacactctttttgtatctttcatattgccacactctcttgattcccctcctaattcttggtattctatattggatgtccctcttctgttccacttctaaacatctgagtgtctcagggcttgatcttgagactatttatgttctcctggaggtctctagcgccatggctctagacagatccttaatgtgcatctgccagccctaagctcttctctaaaatccacatttatattcagtttcctagggtctctaataagcatccccaaactagcatgtccaaataaagattcttgatactttttgaacaaatctgctcttactttataatattctacatctcaataaatggtaataccctcatcataattattcaagttaaacattaaagagttaacactgatttatttttttctcctaccaattaagccttgttgactacaaatctgaaatcagtcgcttcaatctctccagtacaatcgtccttgtccaagccactatcatctctcacacggactactcaattaatgactggtctttttattccactttcaccccctacattccgttttcgataagccagtcaaagtgaagctaatactctccaatcacttgccaccataattacaataaaatctaaacaatttataaaaacgaacaagtctttatatgagctggccattgcctacttctccaactcactcatcctcaatgtcttagccatattggcttattgttgttgttgccccatgaatatgttaacttgtctttacaccaaacactatgcattagtggtactcctgcctagaatactgttccttttgattgttattataggagatcaatatataccactccaaaatatggcactttgacataaagattacttttagttagaggcaagtaagaatcaatataagcaaaaagaagccttcccagtgcttcccttgtctaaataaaagcagaaacttctgagaaatgataactgctataagccctctctcctgggaaattgttatggccatgaagaatacgaaaagttgatctcaagatagacttggcataaacaaactatactccatgtttctcccatatatttaccttcctacagtttggcaaccctaaatacctaaaccccttttttctttgttttgtcatttctctacaagtttactgttctttgttcagatgctatataaacccaacattctaaccacccctttgagttactcatcactgagtttctaccaggtgtatgtgcactgaatattttaataaacttctaggcttttcctcttgttaatctgtcttttgtcactctaactttgtaggactccagctgggcagcctagaagggtagaaggaacatatttttcttcccctacatcacagagctggccccttcttgtcattcagatctctgtttaaataacatggctcagaaaaaaatgtccttgcttgggcctggtgggtcacgcctgtaaatcccagcactttgggaggctgaggcgggtggatcgcttgaggtcagaagtttgagaccagcctgggcaacatggtcaaaccccatctctactaaaaatacaaaaatcagctgggcctggtggtgcatgcctctagtcccagttatttgggaggcggaggcacacgaaaagcttgaacatgggaggcagaggttgcagtgagctgagattgcaccactgcgctccagcctgggcaacagagcaagactccgaaaggcagaaagaaaaagaaagaaaagaaagaaaaagaaaaagaaaaaaaagaaagagggagggaggggaaaaaaaaagaaaaaaatgtcctagatattctgaaccaaagtggtcatcctgtcacaatctgtaattttaccccattttaaagtctctttatgtatattttctagttattttgttttctgtctcctgtgagagaatgtaatatccatgtcgatacaaatcatatcttgattgttaattgctgaaatcccagtgcgcccaaaattgcacgtcctgtaataggtgtttgataaacttttgttgaattctgaatgttaaaccctttgacaagtgacctgacatgatgaataaaaacttatagggtttaaggattaaaaaatttccataaagaattgtttacttaattcacaatggctaggacttgccaatgggtatagaggccaccagaaactggtgaactattttttaaaatctcataatataagaggaatcatattattaactggccactattctgagttttgaaaaacattttacaactttaaaaaatgattcaaataaagcaaggagacgagtaatgcaagtaatgccaagtatgacttgtgtttatctaataatggactttgttacttatagccacatggaattttagggctgcaaacaacaaggagaggcacctccttctgtaatcacagtgttgctataattacagacaaaggtttgtcagcatttccattaaaagaacttaactaagctgttaaatgtccattagcctaatatatggcttataatatcttagctaactgcatattaaaaacagctaattaaaaatggatggatttttaaataaagttatgtaaatacccagaagaaatcagctctttaagtgtgcacatttctataacaatataagtgcaagctttttttccccagtatttgaattgtctatttatatgcattatttttaaaacttaacctaaaatgttctggaaagggattacataacaataagcacaatgttgtcataagaaggaagaatgaacggcttgactactgtgatggacgctgatgaactactcagatttcccttcaataaagaacttgtcccagcaggtggaagggctggtggcagacagccttcagctctcagttttaggggtggtcccagccatgaagagcccccttgcacaaggtcatgacttatttctgagaaggctatcatccaatgactgattaatgcaggagtagtaaggctcactgttctcaggactactctgaagggtcattcgaagctctgaagcttcccatatgtttggtcaattgggaaacagctctatggaggtgcccaatgatattataagtatccacataggccacatacacaaagttcaactgcagattgacccacgtcttgacaaatgctctgtgatccttccaacatgggaagataggcagtcttgagaggaagtctaccaaggcaatattccacccacctctgtatctttagggaagtcccttaccttgtgggaggtggcgatagaacatttctcatctgcctttctggttatggtgagacatatgatgttccatctcagctccccttaaagtacagctgcagagtataaaactgcttaattgcatgacgaaattggcttctcaacaacagagtgcacactgcttgtgttgcatgtcatctggtctctttaattttggtatcatactgtgggacaagtgacacaggaaactgacaccatgctgatcatacttttgatgcctataaaactgtttgggttgactgtctcattaactgctgaatctctcagcctgcttaacactaaggctgttattgggcctgcattacagctcaacttctctttctgtccaatcctgcttctaagccctctcttgaatatgtattggtccagtgggcattccctgataagtattctgcatattaaactttattttagagtctggccgggcgtagtggctcacgcctgtaatcccagcactttgggaggcagaagtgggtggatcacctgaggtcgggtgtttgagaccagcctgaccaacatgatgaaaccccgtctctactaaaaatacaaaattagccaggcgtggtagtacttgcctgtaatcccagatacttgggagtttgaggcagaagaatcacttgaacccataaggcggaaattacagtgagacgagattgtgccattacactccaacatggacaacgagagcaaaattctgtctaaaataataataataataataataacaacaaataaagtaaaaataaaaatgttttagagtctgtttcccagagaacccaacctgtaacacctacttagtatgtcaaagcaaccaaggaagtcaagggctgtattatttctctttttatttggctgtcaggagttgtgtttattactctatctgaggagcccagagtgattttacgtacacgatctctttttgcagtttcatattacatgttcttagttgctttaactagatgactgctgagcaggcatctaggccatctccactgaagtcgtgcaacctcttccaatacaactccagcaggcagccaggtttggaagtactctattccattacatctaaaaagtatgccttttgttttcgagacaggatctcactctgtcacccaggctggagtgcagtggcaggagggagcacagctcaccatagacttgacctcatgggctcaaacgattctcccatctcagcctcctgagtagctggggctacaggggcacactacctcgcccggctatctatctatctatctatctatctatctatctatctatctatctattttgtagagatgaggcctattttactcaggctggtcttgaactgctagcctcaagcgatccttacaccacagccccccagtgttgggattactagtgtgaggcactgcacctggccattatttccttttgttatttccactcatttgttttattgctccctttctgagcaaagatgatgctttaacatcctttgtaaaaaacagcctttgaggttaacatacatctacttctcagttttcctacaactagatttttctaccccatggagaaatagtctcaattacaactagtcctaagatcagctctttggggctatttgattattcaaaagtcctatgtaaattgaagacctaaaggataaaaagatccctcccaaccatacctcccctacatgtgtgatgaaagcttcagctgagctagatggcccctttaatggtgtttttaatttatacctgctcttgatggaagagaaaataaaggagttctccaaagggatttaggcgtgggagtcaatattagatccaaagcaagggtcattctgttcctatgtttctaagggctttctcatttactcaatctaataatttttaagcacctcttattgtcctagctaacaccctggatgaaatggtcagaaagcactacatgtatttgacctcagacaagtaatagaaagcctattctgactttttaaataacatttcaagaagtcctgcataactcctttctattattttatgaacatagtccatggaggcttccaactagcaacccgtgaacttaacctaaggcttctatttaatgagtctgatagccacctgaataaaaaatcttttttttttttctttttttgagatggagtctggctctgtcgcccaggctggagtggagtggcaggatctcggctaccgggttcaagtgattctcctgcctcagcctcccgagtagctgggactaccggcacatgccactacgcccggctgattttttgtatttgtagtagaggtgggttttcaccgtgttagccaggatggtctctatctcctgacctcatgatccgcctgcctcggcctcccaaagtgctgggattacaggcgtgagccaccatgcctggccctgaatcaaaaatcttttgcgtagataaggaaaaaaaaatcaacagtgttgtataaggggctcatagccacttcatggattgaggtagcttacaaagcaaaataacagggaagtgccacaaaacaattcaatacactactggattctttgaaccaaaaccttgaaaacagcacaaatctgttccagtacttgggagatcaaccattgaaaattaacatttcatttacaacttctgcctgctcttctgttctagcctcctcttctgttctagcctgctcttctgtggctgttcatcgcagccacatttgtaggtttaaatgttcagattgcctagaaagctttgcatatgcaaatatatgcataatcatctggttatgctttctatcagactcataaacctgctttattctctccagcatttttcttctaatatttcataaatagggctgtaacctcaaccttaaattccaaatattctgaattttctttttgtctataattgtattttgtcaagatttttttttactaatatttaaaatgaactttaaatgtttctgaattttaatattgaaacctcaaatcctcacacactcaccttaggtaagtaaaaaagctttagagcttgagttagtaagaaggacttagtcaaggaaagagacaatacagtgagtgagtgagtgtgtgtttgtgtatgtgcctgtgtgtgtgttgaggggtcatttgtgtattgcacatgacatcgagaagtgagggatgtgaaaaccaagatgtttccttcctgaggccgtgtgacctgattcagagctgcatctcattcacctcttaggtccctggttggagtgcctttttcaaatgtctctgcccaaagtgagggacatcttttattaaaccatcaagtcaaaacgagtgatctttctaatacatacaaagactcaggatatgccatatacagacatgcaaatgaccaaggcctattttcaagcattattactaaaataattatttgggataaaacttaataaacacaagtagtatctgctttatagatagatgatggtgccaaattgaatatgaatatcagttgtttgcaatagggaacatattttccacataagcattggatacttagtagctcagttgccaattacactgccgactctaacttaagctatctaatgaggacaacagacctgctattgggattacggaattcaggaaacagtaaattcactctgagagcaattgagatcctctgaaatggggtctcggaaggcggggaattaataacagggcctttgagtatggcctcacaagttgtaaattgcttccagaggcactgagctgagaggcgcagagaagctgaaatcttcaagccacgaaacctggccccgggctctatctgcccagtaaaaggaccactgttttccttctctcaagggatccacatgggttagcacgtgtcttaagtgtttgggttatcatgctgactgtacactcttgaaaggcaagccaaattattccttcctagacaaaagcaagaaatatatgaagaaaaaagaaaacaacttgagaggtgagatacttgccacaagtttggatggacaacccttgtaaattgagcattcattgcagcatccatgcttattttaagtgtaagttatatacacacacacaaacacatatgtatatgcatatgtatgtatgcatacatatacacatatttatttttatttaaataattttttatttgtatgaatgtaaggggtacaagtgcaattttattatgtgagtatgttggatagtggtgaactttggatttttagtgtatccatcacccaaattatgtacattgtagccattaatttatcactgattcccttgcacacccccacacttcagtctccaatgcttatcactacacactctatgtccatgtgtacatgtttatacattatttgtctttcacttataagtgagaacatggggtatctttctgcttctgagttgtttcatatatatatatacacacacacatatatgtatatatgtgtatatatatacgtatatatatacacatatatacgtatatatatgtgtgtatatatacgtatatatacacacgcgtatatatatacgtatatatacacacgcgtatatatatacacatacactgatattgatggcttttctctagaaaaagtataaatctctatatttatcaaactgtgcatttacgatatctggcaatatcttatctactaaatcaaaatgtatacaatgtgccccaatatttagcaatctcagttctgggtatacacccatgtgaaatgtgtaaattcttataccaaaagacatgtaatagaatatatgtctgcaacagcactatttgtaatagctaagttatcaataaaactgttatatttaccctatggaatattatgcagcccataaaatgattgtttaataactacacacaagagaatagctgatacacaaatacaatgcactaagaagccagacattaaagagcatatattgtataattcagcaaaaatatagtagggcaaaaccaatctatgctgtcacagatcagatcggtgattactcttgggagactaatgattgcaaagaggaaccaggggtactgttttgttttctttcttgaagtggatgctgattacatgactggctttagattttgaggcatatacttgtgatacgtgcactttttattgtatatgcacttttataaaattatttaaaatagagtacagatctctaaaatgttagcataccatagttttcatctttttgctactgctatgaaccacatccagagtaaggtgtttcacgcatattatctttaattcacacaatatggattgtatggcctgtctggtcaggatgattaccctcattgcacaagtgatccagcctttgacgcaaaaaactgaatacattaattggcattcatcctttgttgttgggtgggggggaagaagcacaatcatcatcactgtggatgtgttcatgatatgaattgtcactccaagtttccttgatgctttaggagtataaagatgatgtagctgcttgaggccactcatcctagaagcagtctggagaggcatgtgacagtagatgctaattgacattcttatttgtctgtgtcaacaatctaattaaggttttttcctgcctagtagattggtctcattttaattcacagtaccaaaaaagaaacacttccaggtaaatagaacaaaaaaagtcttccgaagaaaaagaaaaagtacaaaaaccaacttaaatggcctggagctccaaaagtactttgttgacaaagaattctgtgaacacgtcatatatattattgactaaaaaacctgcaaagttcagcacaatgctctgatccctagatattttattttatagtctacacactgttaaggtttttgatgttaagaattgaaacgagagtagtatccttataaagcattcttgcctatcttaaccaccactccctttctaatgactaggaaagagtataatgtaaaataaaaaattgattcaaaattttcgagcatgaaaaaattatcatgagggaattcttctccttaacttatccactgatgtagaaacgtacatgtaattgagaaaaataataaaatggatgttgacggtatttcccagaagaattaacaaatttgaaattaagtgagtaaagctgttattcagtcattatttcagggtcttttctcaagcctctgaagtacatgtgggaaaatgctacataaacgtagcagaaatgttaatttctgcagcttattaagttagttattagcctataattcaagatctttgagtatcattaaaggacccgcacaggtacatcattttaatgacttatgtgagaaaatagatatataaaaataggaacatgatctggacgttaagaaataattttgaggttctccttactgatacatcgtgttgtgcgttggaatttttgccctgatattgacccgctagtccgagtcaatcagacctggaattctcctgatgactggttctagactaagagcagtctcatgtcctaaattggctcaaatggattgaagagacatattccaacgaggtggaagaggttttctctctcttcagcttgtagcttaaaagccaatctatgactacaggaggaataaaacttaggaattcacgagcataaagagtaaggccagtaatcaaggcatccctatacttggcaaacctggccactctgaggcttctctttggaggattccacctctgctacatctagacaatgactcagtgttatttctggatataaggcactgctgggaacacacagatgaatctgacatgaattctataatgagtttctcaggagaataatgaattttggtaatgggaaatgaaagtggggaaatgtactgtatgttatggacttgaccttcgtctataatatgggtgtctgccactcgttcaacaatccattagcaaatcatttaacttaaaaatattttatccatatgttaaattgggctactaaaacatataatgaaagggcatatagagctatgggcttctttaaggaaatacaataacagctaatattcctaggagctttatgcatatcaggcactgtgctaaacactgaataagcaatttcttaaccttcacatgaaccccatgagatagacatggttttcccccattttacagttgacgaaatagaagagatttcagccacttgttcgaggtcatttgttcaaggtcagacaggttccacggtggaacctggaaagtaatctcagatagtttctcaaattgaagctctcaaccaggaactctttttacctccagcatatattcagacatggcataagcagaggacagaggctgttctatgaagcgatgactaaaaaaaaaaaaaaaagtacaaatatttatttttgccatcataagctaaataagtgggctttcctaagtagtttcgtaataggagaaaagctgatgaataatgagatagaagggttggtgttgaggcagaggggctttggagactaaagcaaatatttaaatgaaaatagctctgaagtgtgtgtgtgtgtgtgtgtgtgtgtgtgtgtgaaaacagaagttccataattaataatctactatgtgccaaatactgccatgcacaatcactacaaaagtgaatggccttgatcctttccttttactacagagaatgacacatataaataaaccatgtcaatctgctacgacaagcgctaagattgaagttcattgagtgttcagtccgagccctaaaagaaactactgattgccacatgtatgtaaaggcaagcaagacaaggtttcctggatgagatgaggcctaggctgaaacatgaactgaaaaatgtgtttttctggagatccattcaatacgctatatttaggtatccctttgcttaaagacaaagtatttgttattggaattgatgtgtagtaaaatccgctccttttgaagtaaagttctgtgagttctgacaagggcttagtcgtgtagccatcatcgcaggcaagacacagaacagcttcatcaccccccaaaatgctcttgtgctgtccttacccccatctcacctcctcagaagcaatctcttttaacccttctactctgtggtgtattgtactgaaaataagatacgtttattttataacttttaaattaggttcaggggtacacgtgcaggtttgctatacaggtgaactgcattttgcgggggtttggtgtaaagattattttctcacgcaggtactaaacatagtacccaataattatttttcctgatcttctccctccacttgtgttccaccctccagtaggccccagtgtgtgttattcccctctttgtgtccatatgttctcatcatttagcttccatttataagtgagaacacgcagtatttggttttctgtttccatataagtttgctaaggataatggccactggctccatccatgtcgctgcaaaggacatgatctcattctttttcatggccacatagtattccatggtgtatatgtaccacattttctttattcagtctgttcattgataggcatttaagttgaatccatgtctttgctattgtgagtagtgttgcaatgaacatacacaacgtgcatatgtctttatggtagaatgatttctattcctctgggtatatgcccaataatgggattgctgggtcaaatggtaattcttttgtaagttatttgagaaatcaccacactgctttcaacgaccgaactaatttacgttcccaccagcagtgtgttaagtgttcctattaagagattattaaatccctatccttctaggaagttatttgaagtagtcaagaactacacagagatcactgagacaaagatttgaagaacaattggaatcttacagctagctactatcagaaataacaacccgtagtaaatattatgtagttaataattttctacttacattatgtttaatgagtcctcatcaagaaaccatgagtaacataaagttaataaacagagatgacatgatagaatctccaagaagttgaatcagagattaccttcaaagtttaccagaacaaatcaacagaaattgcatagaattagaaagctctagaagtccattaggaggggagttagaataccttcagagaaaaacaaacaggaaaagtgaaatttaactatctaaggaaaatgtgtgaaagacatatttaaatccctgtcactaacaaagctgaaggaagagtgtcttcagattacaggtgtttcttctacctacatgaaaacctgggaaatgggcaagtgaagagcacagatttatctctgaagaaagaaccctcccaccttacagctactagagtggtcaacccacttttaaggtggggattattcgtcagcgttatccacagcctcagggaaatactcctcaaagacatctcattccttgctccattgcttctgatcatgaagtccgtttcatgatcatcgctctctaattctaaaacttctaaccatgagataagtttctaagttaccctcacacactcaggtatccagtttctgaaaaggtagtacaagtaatgtgaatgaaagagtattccggtttggatatgattctgaattttgggttttttttttctgctgggacaatccaatctaggtgagccaacccaatgctgagggacagaccctggttaaaggagatgcttcaacacaggccatcctatgaggtgctgtctgagaggccagtcaacctctctgaaagctctgctcatgtgtttaattttcagcaacggatattgcaagagaaaagcatgctctgtcattttcctatgattagacaactaataaataagccagctctggcttaaatgtagcacttttaactcaggccatgcccatttttttatgccacacatcttctcaggcacagcgggaacacacttgcggcgtagcagcagcagatgatttttttcaaagaagagaagagaagacacctttggcaaaacagtgctgataaactaatagtcaggagctttgacagaatgttaaagaaaagctgattttcttcgatttttttcaggacaacatctctgttatccttgaattgaattcttattccacacatcaaaatccatatctaagaaacaccagagaattcttccagatacatagaaacttatatatttttttcagtgataagcagtttgattataaaagatataaaacatgactgataaaaaagcatggcttagatgttgagtaaatattgtagctaaatcctgaaagctcaacatcaataaataatggaagctttagaaaccaatgctctggataacatccctattttagaatactcaaagggctgctacagctatttttttttttggcagttccattctccacaggtgatctatagcttgaactaaacctaaagccatcagattttccaggtttaaaacattttaaaatggtcccatctaatccacaggtttttaaagttacagttaataatcatgttactgaaaacatacactagaagaaatgttatcaagacattaattaaaagtcatgttgttaaaatatatacaagacatacactagaatttttaaaaatattattcacatactaataaaatgaaagtaaggaaataatacaataattacaagaacttcaagaatttctcatagctagtagtgaacatactgatcagtataagggcttgggggtttattaatatttctgaggcataactgtcttaaaaagagccaaaagtgagatctgataatttatcagattgtctaagaaaatgttaatattcatcatctataaaatgactaacttttctttggtgtacatggttttcaagaaaacatgattcattatttcaacatttaaaatttgcctagagagcagcagcatccctgacagactggctcatgctatgattcggtgtcaggatgaaaaggctggcttagagacatgttctgggttcaatttccagtggtttaaaagatttcttggagttaggttgtgcatgataatgtgcctcaatctagaagaggcatgggcaactcccagcatgcaagcagagctcctggttaacatctgaaagtattcacccacaccgtaatccgctggtttattccacctttatgaaactcctattacatttgtccaccctgtgcttaaagcagcaacagcttaaaagagggacacttcagacaaggccccttctgggtctctttctctttcagtaccgcagagaaaaagatacaatggaagcaacagcagtagatggaatttttatttgaaacaccaccactaaatagctttcagatgaggaatacaattctttggtatttctattttaaatagtgcaggggctgggctatgagattttcatatgctatctcatttatttcatttatctatacatgtttaatttagagtgatgatgtaacattggatgtggagactccaaagctgaataatgtaatatatcaatacaatacctgcagaaacagctatgcagtggagtattttggttttatacttcctcaaaaatgttcatcacgttattttcactttttttttttttttttttttttttttttttttatagaaacacaggactggctttggagttatttaggggaagagtgcctttggtctttagagaaatcttcctggacaattcttgtaacaaataaaacatcaaggtgtaattatataaaatcactattaaaacgcaacttatttgtactatattttagctgttttaacactaagtgaccttacactcattcattgtttctattgctccctgttattgttcctttctaaaagaatgttctcccttatatactgtactatcaccactacttaattagtttttgtattcaatagtcttgctcattggcgctaacattaaagtatgaaataagttaaatataatggaaaaaataatttcttactttaatagtcactttagtcttcacaatagaattctttaaatctataactcaatacttaacagctgagaagaatatgagtgtgtttaatataaattaaagcagcaatttctgtttcataccacattttcttttcaattcatccactgatggacgtttaggttgattccatatcatggctagtatgaaaagtgctgcagtaaacatgggaacaaagctatctcttcaaagatactgatttccttttctttggataaatgcccagtagtgggattgctggatcatctggtagcaattcatgttttattaagaaagtgtttacaacacagaagctcaaaagccttcagctatctctatacaatgccattttaaacacctttggaagattattaaaatatgttaattattttgtcgaaaaactaaaaatttaaaaagcaagacaggtcaacaaaggccagattagaaattaccataaattattaaagtcataaaacatactgaaatctttgggatgtaatttaacacatgagatttacgactactcaagaagcatactatgtagtatgtcacttttgtgctttgagcaaggaacatactttgattcctctatttcagtgggatgaaaacagcttgtgcctctagaattaagacaatggcccacagaattaataatatgataatgaattaaattctctatatttcacagaaaataacaaattttttatgactgtcaataaaaccctcagatagttcaactctgtataactaacaagaaaaattagtttaaaatgtcattttaaccctcctttaaaaaaaaaagcttatctaaatttactggagatatcaatgaggttacggagaattattttaagaaatgtaaaaaggaaccacaatggttctttgctcattaacaaaatgctacataactacaagagatggtttataattacaagaggttaatcatgctttgcaagttgtaaaatttactctcttaggaaataatttcaagagtcctactgattgttaacaggttaaaaaaccttcaacgtttgttaacacattaaaaagtcttcacatatttggcctttaccaaagtaggcagtagtgaccatggtcacctatactttaatagtttttagaacaacttatacatagttcttgaaatggcaataagaattagtggcaataataaataaaacatttatgaacacacaatattgttaaaactccagtgttcacttagatatgtaatctatgtaacaatattgcataattgaagagtttgccaagataattactgatgtatatatatttttcttcatttacaaatattcatggcaaatatgtaatatcaataatgccaaaatgtttagttatttttgtgagatatctcaatacacaaaacagataatagaaatataaattaatgtttgttagagtctatttattttagatacacatctcttccttcaacagcattaagaaatacacaatctccagtgtaggacctccttatagaaaaacattctatcactttgcatagggttattcagatgtgcaggaaagaaccaagaaataattattggttatctattatactaaaattcataggcctgaagggtacatcaaaataggaagatagccaagaaatggtgttcattttcaagtatctttactcaagctaagtctgtaagtcatgtattcacaaaacgatgcttagtggcttgtggcagtacactgtaaataccaaatgagctgtataggactttcaggaaatgatggtttttgagagagtaggtgtggcaggtcttcaagggggcaatgggacttgagcaagtgtcttgtgatgatgggtgtaatttgtaccttgcatgagggtaaatggcgaacaggagagcatggggctagaaaaacatgagacaaatcagaggacagttaatgctggcatttagaagatgtgctggaggtgaattaccaaaagagtctgaaagggcttggagattattcctccttccagaggtgaagaaacaggcccagagtcgttgcataacttgatcaaataatagggccctgtctttttgaatcatcgtccactgcctcgagctacttccatttcctctattctttcactagttaaaatgtaccttttcactttgtgaaaatgacgtgagtgagagtaatagaaaatatctcgttatccatagtttcaagcctagatttgtggaagtcagaatgacagtttcttttaatataacaagttttcattgataaaattattttcagaaaattctctaagtactcttgagttggttaaagtccttatttccctccccaaagaaaatcttaaattcctcgagaccaggtctgtgtatgaatcatctgaaatcctccccaaagggatggataatgcctttgtctaaatgtaggtgcttagtaaattatggataaaagttgaacagcactggcaacaataattcacatcaaagtacattctagttctttatatcacatagaaataaagaattttcttataaattttgtaaatgtgaaagaaaatagaaccaatttagaaaataaatgtcaatcttgcattttaattgttgctcctttcacattaattttacaaaaacttgtttctgatttgattttctatggattaaaagcattctgtgcagttggaagctcattattaatcatgacaactgtagtggctgctagtatgaattaagcacatataccatgtgcctagctaaatggcaagccattcagatctctttctactacagttgattataagtttttttttttattatactttaagttttagggttcatgtgcacaacatgcaggttagttacacacgtatacatgtgccatgttggtgtgctgcacccattaactcgtcatttaccattaggtaagtttttaagagtcaggcatgatatcttagccatctttctatccaaaatgcatagcatgatccctgacatgtgtcatgtgcaatccaaatttaaaaataataaatcccctaccaaatacatttccattaaatatttcacatgagttatctggtttaatcatcccccaaacctcactttacaaatggagaaacaaaagtttcacaaatgtaacacgcccaatgccccacagatagaaagtggtggagccaaggtttgaacccaggctctttgactccagagcccctgcaagaaaatacaactctatgctgccttgacatagctcttcaaataaacagccattcaattatgctcagtgatttcctaatagtttccagaattctagccatgagaaaaataatggttactaatttgaataacgtaagaattatattaccaacaaaaaacgggaggccatgcttaggagacactgtgataacagtagaaagctcaaataaataatttttttaaagttccaagggatccattaaaaaaatacaaaaaaaaaaagtccatttctaatattttattcacagtgacgggcctgagcataacataaactgaaggctcttaccatgttagaaaataaacttaaagtagagatttcactggagagctgaggacccaggtaggtgaggttctgagtgcatctaacagaggggttattagccacatcattcaatcacttaaaataagactatatacgcatagcattagcgagtcaaccatcattaagacaagcggatttttcggagactttagcatgagtccagatgaccaaactcctctgctctgcagatgccatatgtaatgcagatttgcatatttctaatgtattcaggtattactgtttaaaatctactagaataacgacagctttaataaaatagagtttgaatggcttcaatagcaaagaaaattcttaaagattcaagggttcaagagtagtctacttagaaataatcatttaacccccattaatgaacattttttttggatcagtatctacagttctttttttaaagttttttaaattttaagttctgggaaacatgtgcagaacgtgcagatttgttacataggtacacatgtgccatagtggtttgctgcacctatgaacccgtcatttaggttttaagccccgcatgcattaggtatttgtcctaatgctctccctccccttgccccccacctcgcgacaggcctcggtgtgtgatgttcccctcccggtgtccatgtgttctcattgctcaactcccaattatgagtgagaaaatgcggtgtctgtttttccattcctgtgttagtttgctgaggatgatggcttccagctttatccatgtcccttcaaaggacatgaactcgttcttttttatggattcatagtattccatggtgtgtatgtgccaccttttctttatccagtccatcactgatgggcatttgggttgataaacatatataaagatcactttcttatcctaaggaaaagtatacttgtataatgggaccagatatataaagtgacttagttaaaatacaaatcaaccctaagtataaaattaaagggaattctaaatacaacatgtatatggaaatacctataataactaaattcctaatgttgacaaagcacttgacagtttacaaattcttttactatatcatagcatttaataatgttaatgaagtctgtcacgtaggcattttgcatgttttacagttcagaaaatgttttcttccagtaaatctcagctaaaaactgctgaagctagggcttgaacatctgtcttattcccatttttaacacggactgttacattttcatctactttttttgactaataaagtcaatatgaaagtcagtctagattcaggctttgcacatcttctttacaatgctagcgagtttggggcaaccagataaacaccaaaagcactcaaagaacatgaccataaattaaaaataaatccataataaattcagatgctatgctcttcaaggaaaaaaatcaaaaaggggtattgaaaatgtgcctgtatttgcgtgatatatgcatatatatgtacgtaggtacacatatttgtaatttatgtgtatatatgtatatagtttatggatgtatatacatgtaaatgcacatatatgtaaaaatcatataaatatatagaaataaataaagatctatagtaccattttagagaaacaataaagcataatttctggcaaaaaattaaagttgggtataattcaaatatcagtccattatacagaaaaagtaaaagtttgtcctaccttggattttactgattataaaatgaaagcacaaatgattaaaatttctagttttacaccaggtactatactgatggcatgcccaccctgtcttgctaatagtccagttttcataaactaccttgtttgaaaatgagaattttcatgtgaagtcagggctccacattggaaaacactgatgtttctaactcattctagatatttcattctctctttctacccatgtaattttagcattgcttgctcctagcacaatgtttggcacatacttgtttcttaatacaagttctttaactcaaacaatataatcatctcagtaaattcagtgccatacccatactttaccttctcttattctcccggggctaaatatgatcacttcaatcagaatgctcataaaacaaaatcacctgattaatgcaacttatgttttcatgaagtttaaatcaaaatcatttggtttgtttcatctcttcattttaaaacccttttaaaatagattagtctactttattgccttggtaaatatagaatgttgaatattaattttaatcattgctaatgattggggtcattaaaaagttccagaatcgtcatctttacaaatagtctctgagtatactgctgtgcatgttgagggcttaggcctttaaatttgtgaggcaaatctatggcctacagtgtgccctatgaacattgcttttaggaataaattgatgttaagaatgtactagtttacaatcccaccaacagtgtaaaagtgttcctatttctccccatcctctccagcacctgttgtttcctgactttttaatgattgccattctaactggtgtgagatggtatctcattgtggttttgatttgcatgtctctgatggccagtgatggtgagcattttttcatgtgttttttggctgcataaatgtcttcttttgagaagtgtctgttcattgtggaaggcagtgtggcgattcctcaggggcctagaactagaaataccatttgacccagccatcccattactgggtatatacccaaaggactataaatcatgctgctataaagacacgtgcacacatatgtttattgcggctctattcacaatagcaaagacttggaaccaacccaaatgtccaacaatgatagactggattaagaaaatgtggcacatatacaccatggaatactatgcagccagaaaaaatgatgagttcatgtcctttgtagggacatggatgaaactggaatacatcattctcagtaaactatcgcaaggacaaaaaaccaaacagcgcatgttctcactcttaggtgggaatggaacaatgagaacacatggacacaggaaggggaacatcacaccctgggaactgttgtggggtggggggaggggggagggacagcattaggagatatacctaatgttaaatgaagagttaatgggtgcagcactccaacatggcacaggtatacatatgtaactaacttgcacactgtgcacatgtaccctaaaacttaaagtataattaaaaaaaaaaaggatgtatcctaccatgatgtgtctttttcctaggactggcataaaataaactaatctggctcacagacaatttcagtttatcctcatttttatcaccatgtgacctcgggcataactaaacatgatctaattttatgttacttctggattcaatgcatttgcctctctctgagatctatttgtaatcaaatttgttaattccatcctgaaagggagaagtaaaaaggaaaaaaagttaacatctttctaacatttcaactttgaactaccccatccccagaagaaactgctattaaagataagttttgaaaactacacaagggccttacattatcttgaacatatatattatttacaagatcacctaactttcttcctcatttaactgaaaagctttcagatagcctacttttttctcacataagtagatgaaaaaaagaaagaaaatcactgtgtattattttcccagatatatatatatatatgtatatatatatatattagctactacggaaaatgtaaatgcatttatctcacaaggaagtttaaagccttggagccatgttttctgtattaacacgtgttttcatcgcttcttcctccacaattgttttttagatttacgctttttcaaagcataaataaccccagtttgtcttcagctgcaatgagaaaacatagcatggtatatatctcttgctatctgtcaatttgcctattaaaatattgttcaccttttctttggagggtttttcttcgcctcctctttcctgactaaagtttcttgcatcccgtgcatccgtcaaaggcttagctttctgttttgtttgttcaaagcccgccttttgggagcttggtcccatctttgcttccctcctgctatcatctccttctaagcattctgtttttagcttcacatctcccttcgccatgcttcttttgcttagaacaataacgcagcagcaagtacatcgattgctttaggaggattttatcttgtactcagttccatgttcctattcattcatttgtctttatttctttaagtttctcgaggcaaatatttagtgttacagatctatgcctacgagttgatgtctggttgccagaattttatcagatacatacacagctcatcacagacaatgtgattaacacttctgcatgaattatgtaaaatgttcgtatcagagtcttttcatagtaaagatattagtgatattatgtataagtgtttatatacattatattttgttatattttgttgcagaacatgttctgagttttcttcttttcacctagatttggagttttaatatggagaagcagtggtggtttaaaagaccacagaatgatgtcagacaggccagagttcaaatacaggttttactactctatggctctatgagcgtgagtaagttaccctagcctctctccagctcaatttaggattactacgaagaagctcggaaacctcacacagggaaaagtcatgtagtgggcatagcacgattagaactataacacaccctcaattaacgttgatacctgctcttattctcatcctcaccattgctattgtaactattttctccccttgcaattggttcccagaatttcacataaactatgaatccagtttgaacttaatatttattgaattattttcttctaaacatttctaattttcccatttcttgaaaagaacttttaccagatgttattcatattgaattgtaaatttaaaactattataataagctgaaatatatcccttggttagaggacttaacactttaccaatataacaattataatcagtaagaacattgcttctatataacattttattacaattttgctatagtttaaatgtgtcccccaaatttcatgtgttggaaacttaatccccaacgtggcagcaccgggagattgtgcctttaagaggtgattgcatcatgagggctctgcccttatgaatggattcatccattcataaattaataggttaatgggttatcatgggagtaggattcatgattttataagaacaggaagagagacatgaacacattagaatactcagccttcttgccatgtaatgtcctgcactgcctcagggctctgctgtgtccccatgagcaaaaaggctctaacaagtctacagccacaccagcctaaacgcgcccactcttatctgatcttggaagctaagtgaggttcgacctggttagtacttggatgggagaaggctctgaccagatgtggcccctcaaccttggacttctcagcctccgtaactgtaagaagtaaactccttttctttgtaaattacccattttcaggtattctgttacaagcaacagcaaatggacttagacgaattctttcacagtataagattttattgacacatagtgtgttgaataaataacagaatgatttcatcttttgtaatcaaaattaagtttgtattagtttcctgtattgttcctaactcattcaaagatcaggtggatgaaggacagactggaaaattttaatgactttacttaaataagtcatttacttatttaaaaagtcacatatttaaatgaataatttggttgtataacacagttactttagaataaaaatattatatctataatattttaaagtaataaataggaccataggctatttatgaaatatgacatgaatttagaatttcgagacaaatctatatttatttaaatgggcaatatggtttgagaacagttgatatgaaacacgatgatgaacccatcttctgatgaataagaaaaacactcaattggcaatggagctgatcatgcattcattgaaattaaattggctttaagttgtactagtcttcttatgcaacgagtagctccttattttgatgaaaattccccaatttataactaagactggatcttgttattttgatcagagatgcaaatgtctttggaaaaaaagttgggggttcttaatcacatgacttatcactgagaatttataaaaacattttatccccttgtagaaatcgatctcaaacttagggaacatataatttagagaaactatttttaacccaacggagctgcatttaggttactccctgtgattacttttgaacttggtagcactcttcttggttagcactgttatttggagacaatatcatacgaggtttatcttgtaggacatgttcagtaatttcctggatagtgttcaaattattaatagctaatcattattccagtgaatataatacagtgtactttaaaagtcatcattatatatatgctaacgataaatgaaaaataatcatacgcagatatgagaactataatgttggaataaagtgcttcattgctgccccacacgcgttagcacttgaataaatgtggatataaagtagaaagaaatattaaatatcaagtgttattccaaccattaaaggatttttactaagagaagaatctttcttcacatgatgactctataacttagctgaaaacaaaagcgcataaatggcctctcctgaagctatgtcttacactccttctgatgacatttcaattataagccgaagctccacgaaacaatcgattcctaaaggtctaacaattgatcactccgtacactgaagtgcctgtaatgactactgtttataaatgttttgctttaaaaaataaggcacactattaataaacagtttgctttaatagaacaaatgcaagttttcaaaatatttatcagaccacgactcttcctgactcagattggcttcagatgtatgtataaggaaggcctattatattcgtaaacactgctaagttgagagacctgtttctagatcccagtaaatagttaagagaaattcacatcattgatctggttgcatcagtttcacacagtgcacaatcttatataaccttttttccccccagtggctattcatttaggatatcctttagaacaaaagaataggattgagtgtcatttagcagaaagaagggagctaagctgacaggcatagtgttctgttgcagtattttgtgttttcatcattggacagcaatgactacagaaccggccacggcagcaaacccctcagagttcagggcttgggagtgggggagtgggatggacaacaactgaggaggcagagacagagaactgcttagcaaaaaggaagaagaaatcaataatgattatcttctctccttgggctactgcaactctgttaatttaggcatgatttttgtactacatattctttgaattggaaaatatatttttgatgtatttcgggaggtaatacataatccttctgataagcaatatttgttgagcattttatctgctctaattatgtcaggtgctttgctacttcacagtaaccacatgataaagaactatgaatagccctagcttagaaataaaagtaaaaactagagaggtaaagcaacccacccaacatcatatacatagtgaagaagctgccaggactggaggccagatttgcctgtgtcctctaatgctaaatgtgcacagggcttagagctgttctgaattctgtaatacccaatgtctccctttttagaaccaacatttagtaacaccctcatttaccaccctgaaatgaaatgaatagatctcataaacttgtctgcacagtgatctaaccatcatataaaaaagaaagaaaataattcataacacaacaatatatgttttattttattttaaaatactttgaaacgtgtgaatgttttcatggccacaccagaagacctattgaagatgccagacacttgcgcctatgttaagaatcccctttaatgtagaatttttcaaatgtcccctgaatataggtgagttgtatggaacactcaagtaccatgagtcgcaaggctattaagtcctagttttctgctatggaaaagagctcctaggaaacttctagaaattgttctataattgctgcattcttgaaaaattcagcaactatcaaaactgcatttcctctcctgtctccctgctccagtaaaaaacatccacacaaaacacgctttgtgtttatatgttaaatggatttacattctaggggaaattaactataaacaaggttttcctctatttgaatgtgcaggggtatgaggaaacactgtttacgcatcatgaagagtctagtcgcttaccaacacacgttagtgccagcagtgtccacctttcatcataacaaccaaaaatgcctcccttgttcaattcagagagaccatattccagcagaaacagaaatgcctcaggtaagaattgtaacattaagagaacatatgcaaagatctcagtgcagtacttttgcactcaacaagcactaaataaatggtagctattagtgaataatgacaattctatatttatacagaattgctcttacaaagcttatattaacagcttaaacagaaattgtaacatttatagcttaaaatgaataaagctatgtgtgatacattaaatgatttaaattttaaaaactgtaagaattaatgtggaaaactggttttaatttgagttatttcacatacacaaatgtttgctcttatacacattttattgcccatatgatagaggtagactttcttctaaaacaatcatattaatgatttaaacaaaaacgtgagtttaatatgcattattattcatgcttcataataatcacctgatctcttcaaatttaactgtcacacaaagctcagttccttttcatggctataaattacatttcagaactttgtgtctttatactgctaataagtcatatttgataatccagcatataataaaaggatcgtgtacaacattaattacaaggtcagttagatgtcaatgtagaaactcattgaatagtatttttgtggaagtagctagactctattatgtttaaacttcaccataatgaataatttgtatcagacttaattcacgagagaaaagtgaaagttctgcggcaaagtggctttttctcccgaaataatgttaataattgaaggctttcaaaattttttcctgcaaatttcagatgtgattaagtgttgactttataaaggctggaaacgtcaaacactttaaagtaaaattgtgttttcatcttaatttaatgatgaaaaacatacttatgctgtctaatagatctaaccaagaatttctgattcatttgattggtctacctggaaaataataaaattaataaaggagagtataaaatgcatattctgtagtacataaatgatgtgtcttttaaaatgtcaactgaaataatattttttaaaatgaagccatttaaaaatgatttttagtgtaaataagatgccagaagatggacaggtataaaattaacctctacccataaccataatttcatagtagttaatgagctcaactcaagaaaaggatagaagtctagtcaggaaaagggtaatgcaaagtgaaacattaaagttaaattatttccctcatttttggtaacaggttattaaaatagacttgaatgggtttttcaatatgaaacactaggatgagctttctgtgcttcagtttcttcatctgaaggagaggctgtctgagtaggggaccataagaatccacttcagcttctgtagtctatgatatatctgcatttttatcaggcatttattattattcccatgtagcagggaatgttctgctccctcccttgagccaggaagtacaatttgtatcaggatctcgaattatgttttgctccatctaatcccagtcatttctctacatatctgtatttttcaccatacttaataaaattatagggatttcttcttgttctaccacttcacttcatggtctccacttgagtaatgcaatcaactggcaggtacaattaccatgaggcagagggaaatgtttcttaggacccaggcaaaactgatttattttcctttgtgccaaatcttacatgtacttttacaccaagttaacctgcttaggcaaagggaggagccatctttttcaagctctgcaatgatccttgagaaagcagaaaagtcaatgggatctaatatttttatggtgtgagttccatctggggacatttgtatggggttgaagaggaatgcatttgatgaggcagtgactgtttgatcttaggtaccacgttcctcagtatgtgggagtgtaaagcttcatgaacaaattatttttagttgagctaaatggctatgagttgatcattaatgattaggaaaaagagccaggatggaggattacgctcttggccttgaagatctctaaggcagtagaaagagtaataaggagtatattagggttccttagagaaacaaaaggaataagagaatatgtatacacacacatatataattatatgtgtgtgtgtgtgtgtgtgtgtgtgtgtgtgtgtctctgtgtgtgtttgtatgtggtaagaaattggctcatgcaattatggaggcaactatggagactgacaactcccaaggtatacagggtgaacaagcaagctggagacccgagagagctgatagtgtagttccaatcgaagtagagcagacttgagatacaagaacagctaatattgtggttaaagtctgaaggcaggaaaaagcccatgtcccagtttgaaggcagtcgggcagaacgattcccttttgctcaggggagggtcagtgtttttcttctattcaggcctttaattaattacatgaagtctgctcacattaggaagggcaatctactttactcagtctaccaatttaaatgttaatctcatctgataacacttgcacagaatcacccagaataatgtttgaccaaatatctgggcaccttgtagcccagtcaagttgatgcacaaaattaaccattacgggcagtgttgacagatcaaagtagtggtaacagtaggtgcaaagtgaacaacagtatcattagaatgtccagggactttttcaattccagaaacatattgactgggtttgatgccccataactttacaagtaacaactattccacatgatactcaatgctcatatgactgccttggaggaataattgacattctctaccccctgtcccaaactttaaaaaacattttgtgtactgaaatgatttaggatgaactgtgaccggaaacaagaaaatagtaactcacggggtggtccaagcaagatgacagccaactttttgttctttgttttgttttagattcttaacgctttagtgaagttggatccacattttgatcattgcaaatattagaaacaacttacatgttcaacaaggtaagattggttaaaaaaaatcagcacaaatacaacaaaatactatcaggtcatttaaaaatgtgaaagaatgaaatttaagagcaaagaagaatctcatgctacagagatttctcttacaaagaaagtcatctaaattctcatggatagaatgcaatagattaattaggaaacagtatttatagaaacaggattgttactcgttaaattgccataaaattagaacaagaacaaacactagcttaaaagagaaaagtgccttttcctgaggacatgtgatacaatgatggcatttacagaaaaatgagttaatgatactgagggactggcaaaaagaaaggaggccattttcatggaaccaaggaaaactatattcaaaggtggtatcttttctctgctattggttttataatcatatacctatagctacacttaaaaattaaaatacttacagaaaatataactttgatattgatagtctgaaactctctaccccaacctcttctcttaatggataattatgtttaagatggttttttaaataacgtgaggttttttattagttaagaacacaaggagcatgttagaatacactgcatgttgtgaagttcagaaagcctgttataaaagagcagtatcttattgccttttcataaacatacgaatgtttaaaattcatatttatataacaggaaaaaagactattaggaaatgtttgaacatgaaaatgtatcaaaatgttaaaagtggtttgctggggaaagtgatattaaagaagatatttataattttttctctatgctcatctatcagcctatacatttttcataataaaccaatattatttgcatattctgaaaaaagtgttatttacttgttagctaaaatttcatgttatttgattcagactgtgtttcttctgctcagtttttggaatgctctctctctacactcaatctatctgagaagaatcaacagctacaatacaattttttttttgcatttagagactctatgcgcccagaataattctgtgatatgtatttctctttatctaaaagtctatatagacaaggggctctgatacatggtttcttctttaagccaccatcgaacatgctgcaggaaagttaatcgtggggatatccaacagagacctgtatcaataacataagaaaatgggaaattcacccgatacttttatttcctagggtgaaaaagaaattagagccaggtaatatctggtataaaaataggtaatatcatacaaaattcattaaagaaaatctgagtgcggaaattaccaaatcacagaatattagagctggaaaagacattgtacagatacagaaatttgaaaaaaaaaaaatacagagatgaagtgatcattctgctgtcctcacagaaatgcctgctacttctattgaattttcctctcatcttcctttaagcatttctggagtgcgtggtgtgtgtaatcataaagttttgtgttaaatgccaaaaaggaggaaatcataaaagagcggtgtaatttttctattatattttgatagtcctgccctctgcataattattttgtttctaatgtctccaacataatctcttaaacatttcttaaaatattttttttatcctaaatgcgagccgactaaggcaacttcttgacaaacacacgtcaaataacaccaacatcaaaatctaaccattcacatccatgaggtaaagaaaaccaaattaaccagtcattatttttcaatggctatgacttttataatagtacagcttagtttctatgcatcctcctatattctgagattcagcgttatacattttcaatttgattttgccagtcaaatttcatttgttcttgtttgattggctgtcgtttacctattaggtgctgccttcaattcatttttacattctctggggagacaacctacacacgaaggttttgccactttaaatgtttaattctgcaacacgttgcagagtaaaatcttcctcgatttatcctatagaagtttcctgtgacaatgcaagtgaaaaaccaaaactcaaagtgtggcaagttggagctaaggctgatcctggaatcaactagtttccacagtaaaaaaagaatgagaatgagacatagattccccacttaaatccaatagaggtagttttcactctgttatcatgcaacagtgtgtgatagtcaatgttgaagtcatataaacaagttatttggttttagcatttaaaataaaggagttctatcaatttgtggtaaacacaactacccatattgttctcttcctttagactctaactggagaagagagtatattttctgcctcttttcccaggtaatagcatttataggatgaggagctggctaatggcttcagttccacatggctagctacactagggggaaaaaaaaagcataatgctgcaagcaaaattccgatgtagtcacaagaaggacattctatttccttttgaaaaaatgtgtttcaggttcttgggtaaatctggtggtagaaagtttaccacctataattctgtaatgtgatcctcctttataaaattgttattacttgtggcaagaaaagaggaggcagatggtactgtgtcagatgctgaaaaagaaagtgagcatctcctagaatattacagtggaagtatccaacattgaaggcagatctctggaatacaaattcagaagtaaataaaatagacattctacaaacagtgaccaaataaatgtctggactgtgaaacagtttatccattgtttacataagaaataatgcggattatattgcatagctagtatgtaccccaaaccaacaaatatattttaaaggtccatcaaacagcccaataaggttccattttcacatacgcatgcagcattttataacagtcctaggatatgtgtatatacagagggatggaaaaaatacagttttaaaagacagaaatttaccctacattttattgccatctgggcagaaacacacgttccattcttttcgtttctccgtggcttctcccaaagagaaataggcctgtttctttaaacaatttttttataagcgctatcccttcttgaagttgagtatagcataacaaatttactaaaatttttttcttaaggataacagtagaataaagaacaatgagccactttgttacagagataagccatgtcattcttttggtttataatgtatttgcccaaaagtattatgtggctagctgatagctgcatagactaactacagctttttactatttgtgatacaccaggttccctttaatcaaacttcagttatctgtatctatattctccttaggataagcctagattgtctaaatttagagcttgctaccaccccagacattctttctttttggttatcatatcaagtcccaactgtgcagcctggaattcaatgtcaaccactttccatacctcacacaatccctgtgattccatcagctctgaccgaatcataataaacaacagtttattatgatgcttcaagtcccatctctgcagcaagtgcttctccaggtgatttaattaccaataatctttttaaaatctgaaaccccagtcccgtttttgcccattgagcagaggctaggatttattatacagaggatattgttttattatctatggcaataaattattctcttgttactctatagttatatattacattctgcaaacaaatttcagatacctcaagggcatgaataatatatttgattagctgatttattggcatagaatgcatttatcgagctttaattatgggccaaaaagtgtactacgccctgaagtcagaaagatgacaaagaaatgttcttggctttcaaggagatcccgtccctcgaattcattctaataatttttagaagagagttaaagaagaatgctctagaccagtggttctcaaactttagtgtgcatcaaattacctagagggctgataaaaatacaggctgctcatctccactctccaatgtttctgatcaagcaggtctgagatgaggcctgaggatctatatttctaatgaattcccagatggtgctgatgttgctggtccagcgaaagagtgatttagagaatggaaaggcaattaaataggcaatgcaaagacacaacgaggtagagggccaactgtattcaagtagcagcgggaaggtcatatggtgggtttagagggtgcatagggtgaccacaacatggcacttggagacgaatagattataataggttttggacatcatggtaatggtaaggaatgtagatattagaagaatcatcatcatcagaaatttgtaaataacggagggatgtgatcacacctgggctttagcttttagaaagaaaacaatagggcagaggatatgtctacacagaggattgtatcatactgatatttagaccacaaagatgagatttgattttctttcaacactgagggctaggtatcatgcttcatatttatggtctgtctcagctttcctcacctggccaattttaacaacctcctagggaaatcacagcctccagtccacctcctctctccctcccataatggcaagtagatatctggaatcccgctattaaatagcatcaacatctgaattcatgtgtttcaccgatttctcaggctattatagcaggagaaactcatgttgtaattttacttatcaggaatttgaaagccaaattagttaagtaaattaaagtaacgcagctagttaacagcagagtcaaaactagagctcaactatctcaatattgtgtttattagtataataaacgcatataaataaatgtaactatttaattaattgacaacaatatgaatagttacgtttgcacctgcacaggcaataataactaatgcacagctgtgacaccatcacctatgagacgtatctgttttcagaaatattaaaaacaaggtgcatccagtagggtgactatagttaatgacaatctattttgtatttcaaaatagctataataaaatacgtgaaatgttcccaacacaaagcaatggtaaatgtttgaggtgacggatacagaaatatccttatttgataattacacatggtatgcatgcatcaaaatatcacatgtatcccacaaatatgtacaattattatgtatcaatttaaaaatgcacatcttagttgcaataaaatacagcaaacacaggtgacttttcagggcctcgatttcgttcatgggaagaatgaaagatgacatgactctgatgactttttccatgccctatttccaggcaacagagtgtccttctaaaccagaagagttcagctctaacacagaagactattataaaagttagactcctttgagagcattggctgttctttatttttgtgtatatcctttcctttctcgatttcacaagcaactcctgacgattctaggaatttattgtccaattttaatttcctgatcatagttatagctttgaagttcattatcaaactttgacctcatgccctcattcctacctctcagacacaaattatattattacagggatatatattaatatttcaacatttctgcctttcctaaatccaaataaaacaatagaatactgaattaaattactacgataatttatcattgtttctaatattttcttgttttttttctgagaatgtggttattgaatagactacttttttgattatgcaaggctcaatgtcaacattttgttgctaaattataacattaagtaatccagatcacacaatatttttctttagctaagaaacatgtttaacttccagctacaacattttctcacagaataagaattacattgtttgtatttatctttagcttcagcacttattgcagttataaaatatgttaatatcatgggcataacaactgaaagcgtacttaattgttcaaccttggggaccacataatctacatcagatttctatgggtttttcatgtctctggttatgattgcacctttccaatttgtctctgtgcctcaactctctctctccccttatccatcctgtgtagcccttctaaaaagaatctttgaatatatacttttactcattttatgatcgcctgttcctccagctagcttctctttgacctcattgactcaattcaccttatgcctttcccctaatatcttgtgtctaatcatgtgagacttcttaatatttccagggcagaccgtcctcttttgtcctttcaaggttattcaagctgttgtccacacttctgatgttctccctctataatgacaagcttctactcagcctcccagatgagctaatctaccaccttctccgtgaagctgggtcttacgctctgttggagaagagactactctgattccttcacagattttactgtacctatcttgggatactataatgattttgatgctgttctacctgactaaacccagctgttactatttagcaatggatacaacatagtagatactcaacaaatgtcttttaattagtgcatgagcagcagtatctgcacagtgaaagccactgtctgtatatcctcacctcctactacattttaacctaccacaaatagttttttgatgcatgcttccagtgaaaatgtcttttatcaaggtcaagtatgagctccatattgcaaaacccaatggtctattcttttgtgtttgtctaattgtattttcaacatttgacactgtttttgattctatcatgaaggactttcttcatcccacttgcctggttttctctataaatcacagaagttgcttttgtctcctttgagtattttttttcttcctcctgttttgaaaggtgcagtcaattctcgggctcttttcccaaactctcctcctagaagacttcatccagtcccatgtctttaaaaaccatctaagggcctatgactgccacattatttatttatttattttgagacagggtctcactctgttgcccaggctggagtgcagcggtgtgatcacggctcactgcagccttgacttcccaggctcaagtgatccttcagcctcggcctcctgagtatctgggactacaggcatgtgccaccacacccgattaatttttgcgcgcgtgtgtgtgtgtagaggcgaggtctcgctgtgttacccaggctggtcttggactcctgggctcaagtaattctcctatcctggcctcccaaagtgctgggattataggagtgagccactgtgtccggccaactcttacgttattattccagtcacagtatctgtcttcagcttcagactgatctacccaactttctttccagcatttccacttggatatctaatgagactctgataataagagagactcttgatttcatcacaccttgtaccctaactttttcctcctccacttttccccagcaaagaacttagaaataattctcaattattctcatactttacatctaattcatcacagcaaatcctgtcagctttgtctttaaaatgtatcctaaataccagctctctaactgaccccaccactccaccctagtctgaaccacctctgatgtggactagtaacgtggcttcctgtgctatctccctgtattcactattgcttccatttcagtctaacctctactcagcaatgatgaatgaactctttgaagaaagcagatcaggtatctccactctatttttctaaattcttcaatgatgtcctgtcaaaattatgaaagagttaaattcttttatcacggcctgcaagatcccgtgtgatcttgcccttgcctatacttgcacctccttccttccccaccttctcttacactggaatccttgctatttgttggctaggtcaagtctcttttgaactcagtgcccttgcccttgtttcctctgcctggaatgtttttgcccaaattggagaatatctgctctcatatctgctcaaatactgccccctagagaagccatgccaatccacccaatctaaacaagtccaccttcaatatcattttctattcccttaaccagctttatttccaatatggatcactatctgaaatcatatgtgtatgcatataataaataatatcatttattctctagctcactactagagtgtaagttctacgagactagggacatacttatgtattcttgtatcccaagtacctggcatatatcatgtacttcacaaatatctgtggaataaatgaacacattgaagagatctacattatgccatcgtgatgtaaaaattgttttgagctaaagccatttgaggatcaacagatacgggaaggggctttttctgtactccccctatctgcctaaaagcaaagatttctgaaataattcaactgttttaaatcctcctttaaggaaagtttcttgcaccaggggtaaagagtgactcctgtcaccagagatgagaagttgtcgctgggaaaagaaaattacataaacagactttactaaaacaaacattacctttcattagtttctttcatatttcccaccaactttgtggcttgaaattctaacactcttcttttcaaaacccttgttaaaatagtacataagccccaaattctaacttcattgagctatgttttctgtgagctcccacatacttctctgaataaactttgtcttttctattgccaatctatctgtcgtcagtttaatttgcagccccccaagtaatgaacctaagaggggagtgaaaaagtttttcttccctgacaacacaaatggacacatcaataaatggatagcttgagtaaatttcctcatgtttctaagcctcactccattacatttttattgatcacagcaccagtgccagacgacaaatgggaattcttaagagaaagggcattagaagtgttaaaaggcaaccacagagagctgtcacatggagaaatggtccatgccatcttcatttgatctcactcctagttgggagtcatcagaatggggaacggagatatctttcagcaaggaggtcccagtgatatgattaataaaaatatgtcaaaagacacatgagaatagaagttcatttgatacaagcaaaggttattgtttattctactaatacggttccacagaatccaggtcccagcagtgccccctcttagaaggacaagcctccctagttttcaagtcttcacaaatgtggctagctgacaaaataccatctgatcaagtcataatcttctcagatccttcataaatcttcttactgccatgctcatgtttttaaccccttccaacctcttcgagctgacattaagtagcttcttttaaaaaccagcagaaggttcatgaatgcatatgggagaagagtgaattttaggtcaaattcccaggctatgatttaaccttgtcgcaatttgtactctcccaaatcagagaggaagcctgcctacagggcacttagaatctaagaaagtgccttcggtggagaaaatatttaaccaataggtttgtttgggggatggtttggatagggatcttctatatggacctagaaggattatcatcagagacaaagagtatgtgaactttctgttaatgcccagagatgtgacaaccagagaggctgggcagaacagaatctcagagggcatgtggagcaactgagaagactataaaggcattgtgttttcttacctcaagttcacgtaaggcttataactgtaaaatcatctatttttggattatccatgaaattctcaatcctaggctagcagttttctgcaacttacaagcccatgcctctcctacattcaaaggtttccaataacattacacccagggacaagaagtatattattttattggcctgtgaggtgggggaaggggacaaaatttatataataaagtatcctattttacacagtaaagtttattgctttactttattaaacactgatcactgatgatctgttctatagctttcccaaaaccctgtgtttctggattttcaattatgcagagaaaaaagtgaaatctcctgagctggcagctcttcccctccatcatagttcaaaaggtgacagggaatagcagcctacagagtgaacagaacataactctctgagccatggttaagctccagcaattttggtggtcgcagtaaacactgggctaaacccaaggaacttctccccctctatgtggctttggttatatattgataaccaaagctgatattgctttggttatcaaagcaatatcagcatgacctgggaacttattagaaaagtaaattctcaggtctcaccccacagctaccttatcagaactcctacgagtggggcacagcaatcagtattttaatgagtcacctggaaattttgatgcaggatcaaatgtgaaaaccatcgccctatagcagcaatccccaaccttttcggcaccagagactggtttagaggaagacaatttttccatggatcaggggcgggtggggttgtggggagaggtgcgtgggaggcgatggtttggggataaaactgttgcacctcagatcttcaggcattagattctcataaggagcacacaacctagatccctcgtgtggacagttcacaatagggttcgtgatcctatgagaatctaataccgctgctgagctgatagaaggtggagctcaagtggtaatgctggcggccctgcagctcacctcctgatgtggggccccggttcctaacaggtcactgacctgtactggtctgtggccccagggctggggacccttgctctatagtgttaaaagccaaaggaaagcgggcagatcacttgaggtcaggcgtttgagatcagtctgggcaacatggtgaaaccctgtctctactaaaaatgcaaaacttagcagggcctggtggcgccagagcacctgtaatcccagctacttgggaggctgtggcatgagaatcacctgaacctgggacgcggaggtttcagtgagcttagatcatcccagggcacttcacctggatgacagagtgagacagttaaaaaaaaaaaaaaaaaagccaaaaggattagagcacagaggattggcagtcttgagaactaacgtaaccctatttgcaaggtgacagtatgtatattgaactgtatcaggtccgcaatgcagcctttcgtataactaggctcctagtgcggttgtatgctaatcctagtcctaaaaccaagattaggcaaaaacagacttgagattcatttgagtcaaggtcccattactcagtaactcctgagatgaacacaatgcccatatataactaggatctccggtgtaccctcatcttctgatactgcctccttctcatttgccttgtccactgtgatgtggccctttctgtcttccatgtagatgcataaagccctataccaagcactgcaaacatatagctgagaaggtcctcagcctccagaaacttacttttgtcttaaccacatctgattgatgtttatctatgggtctttatgcgaactgtttcttctttctgaattacccttccctgctttcattcttcattttgggactgattccacagccctgggtggccatcacaccctgtggtcacccttttcagtgcacagtcttgcaattacttgattatacagctgacttgccacctcaactaggagctggttgaagggaggggctgtgtctttcatctctttatcaccagcatattgcacagttcctacctatagttgatagttgataacttttgatgaatgaatgaacgagaatcagacattaaattttcagaaggaaaaaacagtttatccttaaacaaatgtgtctggattcagaagaatcattttcccttcgactttatgctcacaaatgtgttgggattcagaagaattccaaccttttcatttgccttgtccatgttatatggtttcttatagcctagctaaagcagtggttttcacagcatgatcaaggccagcagcatcagcatcacctggtaacttgctagaaatgcaaattctggacctgcaccaaagttactggaccagcaactttgaaggctagcctagcaatctgtggtatagcaaaccctccagctgattctgacgtgagtactactggcctagagttgcttctaagactttggtataactaccagtcagaatctaggtcttcacacacagacactgattcagtaggtttgggatgaagggcaggcagtctacagcctttatcaagctgcccagatgatgctgaaaggtgttttatggattcagaagagtctcaacacattcgtgagcataaagttgaagggaaaaaatgtttaatgaatttgcctggggttttgttacttcttccactcctaacttcatttataatcaaggccctaagcagctggtttccacttaaccttaccaaactcatacaaattcagttgggattatttacaacttccagggttacttgcaattgtatactgagtctccaaggtggttaatgagccactttggatgataacaaccaccttggctgataactaaattgataggtaagcaatgtattataatagcaaccaaacccttgcttctctgatttactgacctgtcacagatatggaccaaaccaaatttctgaaattctggctgctcaaatcccaattgcaacctgattgaggcattattagtattggagtttgaagtaaataatacaaatgcatcgactgaaataggtagagaacaagcccggaagtgcaaacgttcgttagaagttactgatttgtgcagaactctgtgtggcttgggcagtcacttctctttgtcaagtaaacatacaaaacgtttgctccttccaattgcaatggtatccatggtagatacgtgcaatgcatttgaaaataataacttgagatcgaaagacaaaaaatgaatacgctaaggaagtgtggcagtcacaaagaggaatgtatctagttcttaatcagggcagacctcaatattcacatttttagcacaaaagccaaaagggagggttgaaatttacaagtcccttcatcttggttaggctctgtggggagttctccctgcagctggtgggctgcttcctgcttctgatgtctccacctgcaggtggtggcactggcccctgacctcctgaaataagcctgttgatcttctcccacattattcctgctgcctgtggactgctgacaggaagttaggggacgacaaaaagtccctcagtaaaagactcgattaagtggctaaataacgtttcctccgaaagctttcttttcaaataaggttttcaaaatatgtgtgcatatatatatatatatatatatatatatatatatatatatatatgtattcggttttattcagaatgcagaagtgtatctgcggagagcagaagggcattggaaggagtcaaaaaaaatgtgtgtgtgtgtgtgtgtatacacacactcactatatgccaaaaggaaaagcaaacaggagaaaaagatgtgttgaaatcttgacagagcacagacaacagtggcatatttgagttagaaaataaacaagggtgtgcattttagaattctcagatttatttgatttttgtccaaccactacaaagtaaggagtaaacgtgaatatgagggggtaagagaaaataagttgatttaatggtgaactagggacaaagtcctagtgttttgcatttgctctgtgacccaggtcttcagcacctttccttggcaagtcaggatgatttttaactagctcctaactagctttcttgtgttagttctgtttccttcgaatctataggccaagctgcagaagggggctttctaaaattcaggcctgtgaagtcattggccagtataaaagccttatatggtttttcctatagcgtagctaaagcagtggttttcaaagcacgatcaaggccagcagcatcagtatcacctggtaacttgctggaaatgcaaaatctggacctgcaccaaagttactggaccagcaactctgaaggctaacctagcaatctgtggtatagcaaaccctccagctgattctgatgtgagtattactggcctagagttgcttctaagactttggtataattaccagtcacaatctaggtcttcacacacagacactgattcaataggtttgggatgaagggtaggagtctacagcttttatcaagctgcccagatgattctgtaaggtgttatctggattgcatttagagaaatgctggccacagtctaaatagtatctgaaccactaaatacatctctctgtgccccctgcccaccccatctgtgaaattttttgagatcatcttgagctccccgtcacagcacagtgcctgcaacagaactgacacattcctctctaaatgtttctgaataaataaactgcactttggcagacaaattgcaatccctaatgtgaaccttttttctcttatctagacaaatgaggcaaaactactctgacagacttcagtggtagtttttaaattgttgttatttaaggaatacactactcataaggacttttcttctcacattgaacattacaagataaattaaaataattttatctaagtaaatgtcctgacactaagtttagccagacttcaccccttaatcggttttctaaaacacaaaaagaaaacaaatgacacctacatggaaattttacttttgaaaagcagtgaaagaaagcagtgaagacgctttgaccttgagtaagattacagcctctggtccccaaatgagacatgtgtagtcttaccttgtctcaggtaaatgtgtgttcatcttgtatacatacataccacatgaatacaggaaggggaatactaaaacctagtaaggtgaatggttttgtgagcatgcatatatatatatatatatatatatatatatatatatatataaatgatcaaaattgatgctaatgaaaaaaatctgtcttgttacaggatggacctttcttcccgtggttctttaacttgagtgtgcgttagaattgcctacagggcttgatcacagatctgcgggctccactctccaagaatttctgtttcagtaggtctgttgtgaggctcaagaatgggcatttctaaccatccccgtgatgctgatctgggacccacactttgaaaacaactgctctactccatagggggaaatgaatgtgtcaggaaaaaggtgctctgtttctgaagaaagagaaacatgaaaggttagacaaagaatataaaggtaactgaaatcctcgaagtaaaataaattccacctcttaactatacctataatcctttgtttcacaggccagcctaaatttaccactttatcttatagagttgtctgtgtgaatccgctttcttatgatatagtgagctcctttaaacattgtggcatgctttattcatctttatgtctgtcatagattagaagtagtaagtgttcaataaacatttgttgcgttaaaagtattagaaaggaaatagactgtacactttattctcgattggtagaaattttatggtgtaatcctaaggtaaggtacactattgatttcaatgtttgaattttttattttattttctatctaaaacaattcacatgtgtaatgaattaaacatctgtcttttgtgaggtgatacttaaaaaatacttagagacacttaaataaggagcataatgctgtagaaataccatatatggaatctattcaatttaacaaaactttatattgagcttctaccacatgcctgatagtatactcaatgctggaaatatctaatataatgatgttaagagcttcaatttattgattagttagcatacaacaggcaatctgcaaggtgtttacagcaaattatgcttatttactcatcgcaatacctctacgaagttggctttattagcatctccagattaaggaagaggaaatcaaagctttaaaacattaatttattctaaatcacacagctaagaaatgacggaaccatgattcggaccaacgttgtccgaagctagagtctgctttcaacagctctgctgtattgactcattccgaagacagggttagcccttaggaaagccacatgcaaaagagacccaattactttctactgtttaaacctgagcgaaactagggttacgtttacctaggtccaaagtcctaatagaccccaaaggggagctcttttttggatacatgtcaggaacatgttaaggtacaacttttcattcatcaattcaataaatttctcttgaatatttgttgtgtacaattactgtggttctatgaattcagtggtgagtaagtaaagaatgcccaatatctagtgggtgacacagataataatcaaatcctcacacaaataacatgtaattacaaactgaattaaggatgaggagaggaaaataaagagcactaggacagcatgcagcaagaggacttaattcaatttgtggagggggtgaccagggaaaccttcctgagcaagtgacaaccgatcaagaccggtaagacgggcaggaaaacgtgagtgtgtggagtgggtggagacagtgagcagattccctgacaaacggaatagtacgtgcaaaggaaaaagagattacagcactgtagttagagaaatctaaaaaaaaaaaaaaacaaagttagtgtagttggagtacagagaatgagcagatgagagggatagtaaaaaatactgccaacatagcaaaggacagactatgcaaagctttgcacaccattttaaggctaaaattaatgtgaaccttttgaaggagaaatctagccaaggctagatttatatttattaaatatcacactatctgtaggcagaacagtctggtgggtaggggggttactgtgttaattccaatgagagacgatggtagcttgcactaggatactaatgggcataaagaaaaactgtagagatattgagaaggttaaatcagtaggaccaggtgacagatttaataatggtagttgacggacagtgaggaagagtgaggaaaaaaaatccagacttttggcttgcttaactggatagtgtcattcactgggatggaggaacctggatgtgtatcgggtttgaaggacaaggtcgaacattcagtttggtccttgttgagtctgagttgcctctgatacatttaagtggagatgtcaattaggcaggggggtatgtatataagactagcattcaaatgagagtttcagggctggagatgtaaatattagaagctttgcagaaacattagttaggttaaatcaggaacatagataagattacctagggacagaagacaaagtgaagaaatgaaaggagatatcattccttctttggaaccttgtgtagtgaatcagaatcaaaccctgtttaattttaaattacaaagccaatctaaccactcactgtgtagatgaagagaactgaagtcctgcgagttttatccatttgctagattgtaaaagtcaagctggggcaagaactcaggtcttctgagctgcagtttaattctccacctttatcgatatttcttaaaatgtggtcctggaaccagcagcatcagcatcacttatacacttaaaaatgcaaatatttaggccccatcccagatctactgaatcagaagctctatggctagggctcagatgcatattcaggtcagagggctcctgctctattttgtgtaatccccttcctgagtgttagcaaagtgatgggttcacacttacgggtagagaggtagcaggaggaaagtgaagctgttcttgactctgtgccagaagagattacagaaactgaccctctcgaactcaacagaagctgtagaccacattggtacatgtgttttataaactacaatcatgcatgccgtttctgtgctttgcaaaagagacagatagtggtgccaggggaaaggacattagcagtccaagttgattaggtaaaatggtctgacacagtgaggcaaaagttgatttggtaaaaacttgacatagacggcactttcaaccatcggtatccacttaatagatgtaaacagctattttcacgacacaaacacccacacttacatctttagaacagtctcagcaattctgtatgcttgccagataaatctctgctgcaaattatcctccagccatgagatttaaaaccaagagtttctagtgttttgttcctttgaaatatgtaaccttaaccagatgtttataccctgggtcacaaaaatctaattgaatagttcacttgatgtgttcgcacaattaagaaactcttcttccttaataggggaagaggggcaaattcatatgtttaattttcaaaaacacagagcgttctctgctctacaacagtctatcagctagaaatgtctattaactgtctcttctctacttcatgagcacaaagataagttgtggttttagggaccctttgggggatattaagagatcttgaggtaaatgctaaaccaaacagtttagtttgtattcaggacagtagacacgttttatatactatcatcctactttaacattaattatattaaaaaattcttcttttaactgggctatctaattaataaggccagcaacattccttgaccaatatgcttgtataagcttagtttatttttgtgtataggatttatatattcaattgtactgatgaaaaaagtatcaggagcttctgatcttcctttgtgacagtgagaaatacagaactctcagcacttaacaactctgtccaaacccttgcactaagacttgactaaactctagtatggtttctagccccagaaggccatgtccctaggatgaccctagccttcccttaagtgcctgcttgagaaagctcagtgctgccaggaaaatttaatgtttgttctagccaacacacatctgttgataggactcttacctccgtttcttagaacatttactcaaaagggcttacaattgtgaacatgtagctcttggaaatcagaagtgtctctcactcaaggacctgaaagccattcttttcaaatgacatcatcaagaaggataagtcctctgtctcctgttctctgtgggaagatagaatcctaacttcaataacttccagctaacacagctggcctaatcacatttacactgtccagccctttgtacttttttacttctctaactcgaatgaacccccactccttctccctccttcttgccttaaaacaaccaagtcgcctctgcacaaattagaatggatctcagctctcccctaatttcacgaggtattgaataaaatctgtttttacctctttaatatccagctgtgtttatctctgacaatatatatgctctcaaaagcattccgataaataaattttcctcaatgatcaagcataataaaatacatcagctttgttaaatcacctaaatactcaaacaactctaccattagtatgtgaggtagctttgaaagtatttctaatttttctttctctttaatatgccacaggaagggacgaggcatttatttgaaccttcaattatatgctatcatagtaagaagatgattggaccataaatgcaaagacatgtatttgcaattgcattgctcaagaatgccagttatgtccattatccatcccttcaatgaaacaaagaccatccattttcttttagaggtaatcactactgtccaatgcaagacacagaaaataggcaatttggaagtatagtaactagttagcaatattcttttaactttctatataggtatactttttacatgcattaatttcactgtaaaacaagtaaaattatatgattaaaaagaaaaccagcttctaagattttgagaatgcattgcatacaatggtcaatgttaatctagtcaacaaagaactgttcaataaaacatgtttgtttacaaaatcagtggaagacttcctcagaaatattttatgtaacaaatgcctagggtgggctgaagagaaaaatccagtaaaatggcatttcaaaatttatattttcctttacatgcctctaatttaaaataaatatctgatatttttcatagatttagtttgtagtacaaaatcatgaattaaatcctaatgatttgaactataatttaaaaaattatattccaaatagcaagccaatcgattgacatttacaatcttctgataaatgcaaagtaccaattccctaaacatagcgttttatggtgactttttcaaaataactacatcattcaaaactattgagttgcctgtaaaacctaaattgcttgaacattagttctggagaaattttcatgatgcctttaaactctcagtgtcaaattcaacatttaggctttaaagcctatgggtggtatttatcaccattcaacactcgcatttatcacataaggaaaatatgtttaagaaagcaaaactgaaataggaactcagggtttaaaacacttctacttataacctgtgtcgttcctctttgtgtaaagtctatgacctgctgtttggaaagacaccagatatggagaagattttgaaatgcccaaatctttataacaaagcatcgaacagaggatctgaaagaaagagcacaacagaaactcaatgaaatatctagcttatcagtctgacaattaatcatatctaaggccccacctctaatctcagtaccttagccaaaaattaaataccaaggacagttacagtttgctctagatacctagaggaaagagaacctccttttcctcatcttttccatactaaaaatgtatactgtatctttcagattaatatatcagctaaaattttgttacttcaataaaccatttttgcagcataactcttgactgcaaataaaagtatatatactgacaatcctcaaattttgtttttcagctttgcttcatcagattactagaatgaggcagtgtcatgcattgattcaataaaatttccaaagtcacctaataaaagtacattttatgatgagaaaacaacaccaaaaaatagttaccaatgcttgatacctcttgagatgtggacctcttagaggccaatttgacagtcagaagagtatgagtaatgtttttcaaaagtttcatgagtacaaaattaaaatcctacaatgtaataccagcttctcttcctacttaaaggagatcataacgattgaatcaggattacattcaaataagccaatgacaaatgtgaaatgaaagagttattctcaccaataatcattgcatcctaaaagccaaagaaaaactgctataagggacttctcaatcagtccctatagataggaattggtagttcctacagaaaaaatatatatacatctatatatatatagatatggagagagagagagagagggagggagagagagagagagagagagagagagaaaattggtaattctacagaaaacattatgtccaagattttttccttggcttctgatttcgaggccaacgagtttgggtcattttaaagggcagacatcagcaagtgcctgcagtgacaaatagttattagctgcaacacaatactttttatttccaaaggttggccagattgaccaaaggagaatcttttcttctatccttcctttctcatttttcaaagactttttttttttttttttggtcccagaaacctttaagtctttttaagctggcttttttcccccttacgctttagctttgctcttttctttgaggtctcagtgacatataggtcagggacgtctttaccaatgtaatattagtggagagttataacaagggggtgaggacactgaaggcttacacaggtgcctgaataatttgccttatcactccacactggtgcaagtggtgcagaaataagagcagattatggcttttgctacatatacttttggatttacagatcaagtgtaggttttcagaaagtttgagtgttacacacaattattaccaccatacccactactatcaatgccagaattatcaatggataaaatttgtttttattattttctattgacactgagttttatatatatatatatgtgaaatcttgtttctgtataaattcccataatgcacactccatccaagaacaaacataatttaactatagatcatatcacataactcctctggttaaaaaccccaatggcttaacatttaatttataaacaaaaaaagcccaactctttacaacgtcccggaagactgcacatcatctgatgcatgccagatctctcccttcatctcctggcacttacctctccatcaccaaaatccactcacacttttcctcaagtaggctaagttgactatgcaattgcacgctttttgtttcctttgtctggaacatattctttaggtatctgcctctgtcactattcaggttccttttcaaatgtcatttcctcaaacaaaagtccttctctggcttctctgtctggtgttatgtctcaactcacattccagttacactctaccacactgctcacttttctgtataagacatattgatatttaaaaattgttattactttttaatgccaggtgcgctggctcatgcccgtaatcccagcactttgggaggccgtggagggcagatcacctgaggtcaggagctcgagaacagcctggccaatatggtgaaaccccatctctactaaaaatacaaaaattagccaggcatggtggcgcatgcctgtaatcccagctactcggtaggctgaggcaggagaatcatttgaacccgggaggcagaggttgcagtgagcagagactgtgccactgcactccagcctgggtgacagagtgagactctgtctcaacaaaataaaataaaataaaatgaaacaaaaattgttattttttaacatctatttcattagcatataagatccttgagagtaagaactttttgcttctgattcattcctgtaattcagcacctagaaaaacatttggcatatagaagataatcaatggataggtgattgaacaaacagctctttgaaacaggtacgagttttcttgttatcttaaggataaaaaattcctgaagtttagaaggggtaagtgacaggttctagatcacatagcatccagcagagccaaccattgaaagtaagactacatgcctgtctagccaaataaaatgaatttggacacattgtgatggagctagggattgtcaagatcatgtatagacatcctaacattcttgtcgcattggaaaacgcagatattatcatgtattatgagaataatttcttagtcagggatggtcattagtgatgaagaaaaaaccctttaaaactaagataacttcaagaaaatgggtcatttaatcctctgttctactgctgctgttttacacgacattctcctctaggtattacgtattcagtggaaaatatttagtgcttgtaataaagtaagccaatggccatattgtgaagtatagtgctctacactggatgtcagaagacctcagtgccagaccctgcttcttcacacagtagttggagggtaaagtcatctgagactgtcagttccgtaattttaaaatggaaaaagcatatctgtcatatcaacctcaagggactgagagatcaatggagatgatggctataaaagcacattttaaatgccagagggatataaaaatggaaggtcccatcattgttatttagggatgaaggctttttaatctatatgtgttcagtaacatatattgcatgagaaaataggtgaatgatgaatattataaaataatacaaaaatacaatattaatagatataatgcttacctataaggtcaatttgttttgacctaaatttagattaggcaacatgttgcataaatgggtgggtcagtaacggaaatgtcactctaaaaaatgtgcaaggaagcaactgtccatcatggtcaaattacttcagatgccttgaattcatgaataaaacactccatcaaattttatgcatctcaagcacttctcacacatttaaatccacaacatcctagtgaggtagggaaggaggaatatttcatttttcttatttggtgaaatgaggataatgaggcacaaggaggttaatgatagatttgaagtgaatgcaatcagtcagcagcaaaaccatggttggaatttaggttccctgaattccacttagggttcttttcgagatactacgttaactacatttcattgttggaggaatttaattcagtcatgtagatacagatgctcacaacatcttttttcatcctactaaggaatcttgctgctaattcaaccactgagacaaataatacgtggacctgcgctggagatttggcttcggtgttcattcaagtcatttcctgagctaacttctgttccttttcctatgaatactatattttttcacattataccactgaattattcagattcattgaatacccttagagttattaacatgttatatctaaaaaaattactgctttctccttttggttatatagctagaaagtcaggatatagtaaaaggagacccaaaatgtaggttttgaaaatagaacgtcagtttttgaggacaccacacacttttgtttttcttcccatctcattgatcactccttttcttttcttttttttttttttttttttttttttttttttagatgaagtctcgctccatcgcccaggttggagcgcagtggcacaatcttttggctcactgcaacctctgtctcctaggtacaagcaattcttctgcctcagcctccagagcagctgggactacaggtgtgtgccaccacacccagctaattttgtatttttagtagagatggggtttcaccatgttggccaggctggtctccaactcctgacctcgtgatctgcccgcctcggcctcccaaagtactaggattacaggtgtgagccaccatgcctggctgatcattccttttcattatcctgtgctgttttctcctttgtcaatccacctcttaatgttagagtccttagtcacgttgtcatttctatctatattcttccttagtgatacaatctgatatcacagctttaaatgttatcttatacaaacacctccgaaatttaaacgtccaacctggaccttttttgctgaactctaaaggtatttattcaattgcctattcaatatatctggtgatatgtctaacagatatccaaatttaatgcctccctaatcgccccattctatctatagtctttattatttcagtttagggcaactttatcccttccagttaatcagagcaaaaacgttggagccattcatgactccatttttctcccatgccccttatccaattcatccagaaatccttgttggccccacttccaaacacgttcagaatatgactatttcttatcaccctggtctcagtcagcatcatcttctcacacttagaaagagaaaaacgtccttacaatggcttcaaaggtccaccctcacctcactaacattctctcctaaacctctctcacttacttcactctagccacactgcagataaccagccccaaacagcagataaaccgatggcttaggaattctgcattgactgtttactgaacccaaaatgagtttactgctgatatctacatgattcaaccccatgcctcattctttgagatctttgctcaaatgtcaccttctcaatgaagaataccatgataccctatttaaaattggaatgtactccagcatgagccatctcttattttacccttcttcttttttttcacagcacttatcacttttgaacatactatacaatatacttatcgtatctgtctttcactatttgagacccccaagaatccagagggcatacatcttttctgctttgttcactgacacattcaaaacatctacagtagtggctgacatatggtggtggctcaataagtatttttcaaattaacctgatgctaagtccagaactttcaactgcccagtcacagagctagcttcagggcatttaaagaactgaacaaacagataatggaagtgggttcatgtagatagagaagaaattaaaagaattctcattctcatgtagaatgagaagacaatggggaatagggatacacatgtcctttttttttctactgcaggcaaggcacagaagcggggatgtaaacaaaggagacatccgtgaagatgctaatataggttttcacaattctaaaaaaaagataaaataaactatgtgtttaacggtgacatggttttaaagagttgctgaatgatcagtctccctttccttttctttcttccagcgctatattatttcaaagggtcactggttacttcatgggaaccagacgttgttattgccacttgtataagtcagatgaataaagagaaattcttgataaatgaggtatactttgaaggcaaaatgttcagaaaatagggtatatgtgagatgaaaaagtatcctcagagatgaaaggatttgccaaaaactgatataaattccatgggtgcaaacagagttctaagcctactgcaataagatttgactttattggattatctatgaaatatattattgtagtaggggtctatttttatggccacatctggtctagacttcacaaaagaattacaatgggaatatactctaccaagatgccaaaaaacacatatctcttcattcctgaaagatattgcctagactgtctaaatctgaaaattaacaaggattctgtaattacttcattttcatctacatttccccaaactaaaaggtatcctagattatttgagctatagatgtgtttttatgtacagctttttaaattaatagtccactagctctatcggttacagcagtaataaaaaaacttttatggaaagttctctgagactaaaagtgatttacatgcaaatatatggaaatgattcccttcttaaaacagtaacaaaaggtgtgtttgaaaattcatgctttggaagaataaatgattttcacataatcattctagtaagttgtttatttttattgacatgcatcttttattagctatttaatggtggttcacaggggtgagtgcactggatcacgcctgtaatctcggcattttgggaggccaaggtgggcagattgcttgagctcaggagtttgagaccagatggtgaaacaccatctctaaaaaaaaatacaaaaaattagctgggcatggtggcgtgcgccagtagcctcagctacccgggaggctgaggtgggaggatcacctgagcctggatggttgaggcagtgagccatgaatgcaccactgcactcaagcctgggcagcagagcaagactttgtctcaaaaaaatgtgatccacaaaaaacaaatttaagttgttgaatattttaggctagctcaaatacttaactttaattttctattaaaatatataccttatttaatgctaatggtatctaatttgcagctatcgttactatacacataaactgcacaaatcaaaataaatagaaaacaaatattaataaaatttagtcattaacccttctggatgacatgttataattaggatattaattggaattggcattataaaaccatttagaattcgttgtattaaaaaaatctgattccataaatcatggggaattttttattttaatgacccatgtattagacttacagaaaattgtggaccttaagtaatgttttattaaaatgttctgctatttaatttgtcatatttaaaaatagctaaaatcatagttttaattttagtaatatttttcattgtgttctaagtaagccaacccttaaacatcaaatgctttcttttgggatatgtcttttcaacttctggttccctcaggtttgatccattgacattctaggcactgttggtgtgtcccacctagtatataccagccaggccttctttatcatgccccctgggcaaagaaaaactgattccatttatactagaataatatcattgttgtcactacttattacctaggcaattggtcacactctactcccttcttatggtactttcattaaggcatatgttcctttatgaaaaacattccattcctggcagccgaagtcaatctacaaatagccaggtagcaaatcaatgcagattacaagagaaagtgaacaagcaacagagattaaacaaaacaaaacaaaacaaaacaaaacaaaacaaaacaaaacaaatgttagagattgtgacttgaacgtggcacagcctagttccttgttctgccttgtccttcaaaaaacagggtcattattttgtgagattcaaactggttttgaaaattaatcatctcatggtatacaaattctaatccaccgatggatgaagtagaactttccatgtttcttccactgccacttagaaaataatattgggaattgaacaatgagaacacatggacacaggaaggggaatatcacactctggggactgctgtggggtggggggaagggggagggatagcattgggagatttaccttaagctagatgacgagttagtgggtgcagcgcaccagcatggcacatgtatacatatgtaactaacctgcacattgtgcacatgtgccctaaaacttaaagtataataataaatttaaaaaaaagaaaataatattttattatgtacagcgtgcattatcagcacagataacataaaactttttttaaaaatgtgggtttattctagatttttaaatctatgaggcttatttagaatgctgaattaaactatacaagttaatcttgaagaaccagatattggaattgctgctctcattaattcctcccacctgatttgtgtatgccatcgccagcaaaccacatagttggtgcctcctttacaaaaaaaagttgtgctaggagacaagcataaattacaaggtcagaggaataccttcaagaatcttaaacccatttgaacagtatagaaacctagggatggaaaaaactctaatagaagaaaactacaagaaccaaaggggtaagccagtacaacctctgcaaaggtaatcttactccatccactaaacatagcattatatgtttagtcactcacacacaaagatagtgaatgactgataaggagaacctggccaggcattaacaggggatggcctttcattgagtaaaagatattccttccagagtagagctggtaaagccgaagagaactgtattcaaatgaaagtatagttttttttttcaactttaattttggactagggagtacctatgcaggattgttacatgggtatgttgcatgatgaaaagcaaagtttttgatttcaggtttttggagaaacaagagtgcctcggagctgtccatggtgctgcatgagaccaggccttcattctgcagaattcctgcctcttgaaaattctctaggccctgacttacaaccctgtttgctgtatggttaacctgccaaccctgctatgtcccctataagtgattatttaacataatctataatttcagtactaaatatttcatgactaattataacagctctctatgtttccctgggtgatatcaccacacattccaatttggcagatctcggtgggcccaggaatttgtatgcaaatatacatcctcatataattcttatgagggactaaagtcctgcttagactctagtcttcccaaggtcgcccaccttaatcccgagccaactcgtccccagttggagacaagagcagaaattttgattccacaaagctgtttgattaggcctcacatacatcatctggaatcacacaactgaagcttcatttatgacactgctacagtgtaccaattcctttccctatatattttttctttttttcaaatcctatttatcctacttcaaatctctatagcaccatatttagagtcattcagatcttgatttgaatcaataactacattgaaacaactcacttaaccctatattcaagccttcatgaattcacctgtcaaatgaaaaaaataacacctacagctttgcagaattattttcagggtaatatgagacatggtttctaactcagctagcacattatctgatacacagttgctctacttgcatgtgagttctgttccctttccttctctaaatcttttttaaattcttgcatcatttattactttatttcatctaatgaactcttgtttctatcatttgtctcatcaactagctttccagatccttgactaataaagatagatattgcatactaagtgtgtggtggatggttgccaagacctgcacagagcactttacatatcttggccatgaggactcaaatattgagaggcagagttggaattctgaatctcaagctacagctcctgtcatgccatactacagtctattaccattccatttcctccaactgtgcctaagctaagtgcctggtatgtggattaactgctatcagagtcttttttactgtaatggagtagatgcattgtctatatcctatttgctgcatccacataattatcagtccgttcaaaaagcatagccaattgctctatcacttagtaaacgactaacttagaccactggacggaactttttttggaaaccaaaagaaaacagctcctaaattgctgtacctgctctcctcagattattatgtgctggaaaatcggagacgattattcattctcatacacttcacattttccagaatggaaaattaagtagcaaaggcagatgtcccctgttggggcaacgattgagctggatatagaagactcatatcctgtttgctaaactgggctgttcttactattctcaacatgttcacatcatcataataaaacaagcgccccttaagacaccataaatattacaatctcagtcaatatatttatagagtcaggaagagttggatattctcatattcatcaactgtaattcatcaggattattatagttagggagggaaacccaaagttatgacactgaaagacatgatcagtgagttttaataactcaaaacatacttgctatataacacaggaatggcttttgacacatttgtcattactttataaaaataatcctttaagttactttgtggtgatgaaacacttctttatcttgatagtggtagtaactatataaatctatagacatggttaatgtcatagaataacagataatgactcacagtaaaagagcatgtgcaaaaacaggtgaaatccaagtaaggtctacagtctagttgattgcactgtgccaatgtcagtttattgggtttggtaatatactgtatttggttaatatgtaactggggaaagttgggttatgtatacacaggaaatctctgtactgtttttgcaactccttgtgagtctatgaatatttcacaataaaaaaatcttaaaacattcttaaaactttatagaaattttgcctgccttcaaagagactgtaagggaaaatagagaaagaagagagaaaattaaaatgtctggctaattcctaataggaagttttctttatttttatacaagaaacggaaaacatagttgctatatcaacaggattttagtctattttcttcacaaagctgaagaaggtgtgaatgacttttctctgtgcaagtgaataatatactaaaattacttgttccacccttgtttttgtcttgtttacatcctacttccataaacctgccaatatttagtcactaatcttaagctatgacagaatttaaaacagattcaatgatatgatttgaattcaccttatgtaagatattgtaaagcaatatgatgccacaacacacatctagaaaactgtgtcttctctcaaatggaactgagttgttcctaagatgtttaactaaagtgattaaatgggctgaattataacatattgatttttaaatggtctagccacatttgcattgttaattttttacaagattgcaccatagatataaatcactgacaaaatattttaaaagtagcatacaaaaatcgtcaacactgggataaaatttaactttcaaaattaaaataatcttagaaaattcagttatccaaaggcattaagcaatgacttttcaaagttgataaggatatagtttctattgtgaaagtctattagacaagtacttttcaaaattatataggttattgtattagtccgttttcatgctgtgataaagacatacttgagactgggaagaaaaagtagtttaattgaacttatagttccacatgactggggaggcctcagaatcatggtgggaggtgaaaggcacttcttacatggaagcagaagagaaaatgtggagacgcaagagcagaaacccctgataaaaccaacagatctcgtgagacttattcagtaccatgagaacagtatgggggaaaccgcccccatgattcaaatgacctcccactggatccctcccacaacaagtaggaattatgggagtagaattcaagatgagatttgggtggggacacagccaaaccatatcagttattgaaggaaaaatggaagcaaggcattttcaccaccaaattttgctcaaacaaggcagatataacctgcagctgcagaacaattaggtttatgtttttgagaagtttatagttaaaaacatttgatacattgctctgcatggtacataggagttttggtcacctcattgttaagcccattactccctatgcagtaacatttaatatttttaaatgaataaaaataaggtcaggtgcagtggatcacacctataatcccaacactttgggaggctgagtcgggtggatgacttgaggctaggagttcgagaccagcctggccaacatggtgaaaccccgtctctactaaaaatacaaaaaaaaaaaacaaatagcctggcgtggttgtgggcgcctctaatcccagctgcttgggaggccgaggcacaagaatcacttgaacccgggaggtggaggttgcagtgagccgagatcataccactgcacttcagcctgggtgacagagcgagactccgtctcaaaacaaaaacaaaaacaaaaacaaaaacaaaaacaaaaacaaaacacgttaattctcttctaaatggcctcagtgtgctctctttactcaatggcaattagtatgcacaaccccaaacctgcaatttttattctcctttgctctctgtgcctcctaaaacatcttattcctatttttaaagaactatttttaaaattttatttataagaaaaaatccagaattcaatataatatagagtgcaacacacacacacacacacacacacacacacacacacacacacacacgatcttgcatggtttctcaaataatagacactcatgtagaaagccttaattttaatttaaaaattaacactctggaagttacacaagaaatgatgggccttggggccttttgtgaaaatggcaagataacaaggcaggacaagagagatggagataacagacacaatgaatatgtatcagatttcgttgatacgttcattcttttttctacaaatagacattgagggctcactatatcccttgcgctgctacacacgggggatatgctgatgcaaacactggcaacataccttccttcatggtgcttacatcataattgcagactcagacaaaaacaaggcaggaaacagaaacaaggagctgagctatagaataatgttagaggatggtgcaaggggggtagacagccctctccaggactctccttggagaggattacctacccaaagccctgaggctatatagaagacacgattgcagaggaggatgtctactccagagagacactctgcaaattgtattaaaacttcccacatcaagggggatttgctgactctccttttgtttgaatattgtcagaagactacataggaaatggtccatccttcctcaccaacctttacggcccttccatcctctgagaaaaagagaggttttgacaaagggctttaaagtttcattgttttacttgcacttgctgagtccccttggggattttatctacactatccatctcacagaaaagtcgagagcattaagcaaagtaacggttaagaatatgcactgaatatcatcccttcttcattaacacaggacattataattttaaaacatctgactaagtccatgataatatggaaccattcctatccttctctgcacaaaggaggagaaatatctgtacagtctttgaacttagttagatatgggtctgaatttcagatattttactccatgctacgaccttgcaaagcttacctaaattctgaaccccaataaactcatggatacattaaagtaaaagctctgtgcatgcttgttagaatagcacactatacatttaccaaatggcaaagtgcctggcatggagaatgatagttatagtcataaacactagcatcgtcataattgaagaaattactgtccatgggatctagtcaatcattgagtattcactcagcattcaagactgatattttatctgaattccacaaatcacccttcactcaacacggttttcttatcatcatccttcaggtagagcccctccatcctatctctggatttgcatacactgtttggaatatctttaccattttcttttcatcagatatcgacaacttttataggtctactagatcatgaaatcaagggttatgttcatgtattacttggtttttgttctgtcctcagcacccaccacaaggccctgtatttttaaaggagctcaatataaatatattgaatggaattaaatgccattgctaaagttttcctcctcatgttaatctttacccgtgtaaaagaaactatcctttacctagttacacaacttcataataatttattactctgaattttcacaagaacttttgacttaaccactcatttaaaaaaaatctgcagataatcctgtaatatatttctccagcacagttcaccctcatgaagcaggcagtattgagcaagaggctaggctcactggttagacaagtaattgacccctcacattaaatccatgcaatctaaataatgaacactaattgtatgctgtaggctgccagggtctctcgctgtagttaaaagtaaaaatacattttttttttttttctttttgagatggagtctccctctgtcgcccaggctggagtgcagtggcctgacctctgctcactgcaagctccgcctcccgggttcacgccattctcctgccttaacctcccgagtagctgggaccacaggcgcccgccaccacgcatggctaatttttttttttttgtattttttagtagagacgaggtttcaccgtgttagccaggatggtctcggtctcctgacctcgtgatccgcccgcctcggcctcccaaagtgctgggattacaggcgtgagccaccgtgcccggccacaaatacatctttatatgtttactgtctactagatactgaagactgtcattcactaactggtcactgtgtataactaaatccttgtatttcaatgtgattatgaggcccaagaaaatatgtttcgttctgggtacctaataaactcttaagacttgcccatctcccacaaactgtaggcaaataattcttctaatctgcttttatttctttattaagataaagcatttgaggtcacaatgttctatggaaatctagaaattcctaaggcaaaatctaggtgacacaattatagaagatgccgcaactgatttccctcaagcacatttctgttgccatagaatcatctcaaatctgccaactttgaagctgaactcctctccattccactcatatggattctcacatgggttttagtagaaaaatttaaactattagaacatggactgatttttctctggattattaaatgagaagggtctggattccccattacttttctaattaaaatagtatcaaaagcaaagacaaaccaatcctcagcatgtatattacagagaacctgttacagagacattatcaaggccatatttttggtaaaattacttaaaatctgattgaataaaagttgcctctaattcgtttatattaatagcactttaaagtaatacatacggatacaactttaaaaagttgggatttatcttattattatgtcctgttaaaatacgcttataaggaagaccaaaaagagtacactgatgaggatctttgagaaaattaaaaatgaaaacaataataaataaaattgtcatggctaaaaagcatatttagtcttcatgatgttaaactattatgcaattaggcaaggacattcttgtctttcaaaaataaaattcacgggctgggcgcggtggctcacgtctggaattccagtgctttgggaagctgaggagggtggatcacctgaggtcaggagttcgagaccagcctggccaacatggtgaacccctgtctctactaaaaatacaaaaaattagccaggcgtggtggtgcacatctgtaatcccagctactagggaggctgaggcaggagaatcgcttgaacctgggtggtagaggttgtggtgagccgagatcgcaccattgcaccccagcctgggcaacaagagtgaaacaccgtctcaatgaatcagtcaatcaatcaatcaaattcacactttgaaatctattttttgaaagtatataatcataaatgaaaaccaaacaaaaccctcactggctaaaacaacatgatggaaacataaaagtgacaaagtttaagacccatgacacatgtatgtaagttatttcaaaagagatcactgttagaaatttgctggaagtgtttttgttactgtgaataataacacaatttttgtaatttgcaatacatcatagataaggcatatacacacataaacattgtgaatagtggtaacacattcagttattggggctttcactataatatgcctgggtgtgcctccaacggatgctaaatttagtgcatttgaagtctcttggaaaaaaacagtcccaaggagtttgaaagggaaggtgttttaagttcagcacagcatgctccttgcagcagcaaatgtgtctgaaagcttcttgctctgttgcactgtgagagaactatattaaaatgtgttaatagtagaaagaataagttcacctcaaatactatatttccttgatttttgagacaacagtgatttcctgtatgttaaaaattatagagagcaaaatacagccatttcacgctaatttattatctccatgtgaatgtgcatttacattttagataatatatagattacttgtgaattataagccttaaaatgaattcaaacatgtcagtaggaagaagctaccatattacagattcttgaaaatcacaaattgaaattacctaatgatatgattataatttaatactagtatcaaaggtatttttcctattattttattttactaattactgtaaactatcggtaggattataggagcaagacgtcaagatatttattaaccatactaattttttattggaagccatattaaatttaacctgtaaaatgagaaaaataaaaatagtaacctcatagattgtggtaagagtcaaatgaaataacttacatgaaattgctttgtaagttttatagggctgccatgttttgattgtatgatactatgtatccctactgtttaggacatctcttcctgtttaggacatctctttcatatgtgcagagacctgtgtttactgctttttttattcacaatgtggtcttttgttaccataagttaatgaaaacatttttcagtcttgtaatttataaaatgttagtgttattaacaactatacatagatgatagagatagatagatgatagataaaccgatccatcgatagatagataagtaaaggagagtgacagagacagggagagggagagggaaagggaaagggatggtgggagagagagaagtaactgagtggatggatgggtagatgaataagtggatggatggatggaaggagacaggtagacagccagatgggtatatatggatagatagcgtatgatctttgtcctattatttaacttcccttgcttcaattttagaagatataaaataggataacaagagtacctatcttataggattgctatgagcattaaggtagttaagcctgacacatactaagagctcagcaagtgttaagtatttttcactgtagttggtatttggctcttaaagaatctgtcacatatttctatacagtttttaaattcatagattagatgtagcctaataatgagagcaatcatccattaagcaccctctatgtgtctaaacgcagatgttttacataccgtaagtcatataacatgagaataaacctttaagacacttactgctctccccattttacagatgagacaaccaagacttaaagtattgcccaaggtcttagagttggtaacttgcaaaggcaagaacaatgaccacaaaaccagaacaactgacagcagagtatctgttccagctccaataattactggctacatcagttctgtgggtcccttcatgatggtacctatacctctagagtttaaaaataaattatcgtttaatttttgcataaactctatgatgtaagtcaataataattcctcttctttcttaactcactagcatactgtaataaacatccatatacccaccatgcagatcccagcaattataaactcaagggcccatatggtttcatctacatcccaccaagcgcaacccacccctaaacctagctttgtattattttgcaagtgacctaagtgatccttcttttgctgcttggaataccaagttaatgagttatttcatgtgagatagctaataaatcacaaagctgttgcttgagaataggtgtcccaatattgctgtgtttcattttcattctatgataggtagcgtttttatgatatatgtcattggcagcaaaaaattatatactttactgattgacatatgacttctggtgaacgcttaaaatacttgattttgtttttatatacatatgtatgtatgtataagcaaagatcatcccatattcctattaaatagataagttgatatttgacaaatacactgactttagaaaaaatatgaaatcaaatataaaataatacagctgtgtacggtacattgtgatgttaacataaaagaagtagtgaacaggaatttgtgtatgtgtgtatttttgtatgtcatatatgtttgttagcatagaaaaagcagccagaaagttacacaccaaaatgttaattctggtttccaactggcacttagattttctagtatgcttaggttttcatattagcatactgataagaaaggtatccttgagtcttactgtttgggtctgaattcccattttgccattttctaactgtatacactcaaaaaaatttcttcttttttttttttttttttgagatggagtctcgctctgtcacccaggctggagtgcagtggcgcgatctcggctcactgcaacctccacctcccgggttcacgccattctcctgcctcagcctcccgagtagctgggactacaggcacccactaccacgccaggctaattttttatatttttagtagagacggggtttcaccgtgttcgccaggatggtctcgatctcctgacctcgtgatcagcccgcctcggcctcccaaagtgctgggattacaggcgtgagccaccgcacccggccaaaaaatttcttatttatacctctacttcctcatttctcatatagaagtaatagtgccatctaccttactatttagaagactcaattaatccatgtaagttacttagacctgtcattttagatattattatgactacatcagaagatattatgttagtaataagaaaaacattgttaaagaatttgaaaataaggagaataagatttgttaaggtattttgaaaattaattttaaattgttgttttgttagttagtagggtcttaaaatccttcatatcacctccaataagcttctgagaaataaataaatataagactctacatatcccatttcagggatgacttacagagggacttaataaaaatgcagaataaactattgtttttgttttgttttgttttaccagaatatctcccctttgattaaaaaaaaaaagattattgtaaaagatgatgctctaagtctgctttacactggcaggccatagacattcataaataaattcctacaaaatgaaataggaattaatccttgtacaaatactatagctaactaagtacagtttctagaagtatattttgaaatgaaatttatgtatatcactggtgataacttgtactcatttaaatgcttctgaagcattctcttcagaagttaataacttttctaaaataagtcaaatcatgcaatttgacgaatataaattgcagcaattttaccattgctaaaatggtttccgagcattacaagaagagttcacttggctactgtctttacactgaatactttgatgaggttacaataataaagtgacaaagtgatatgcattttcttttataccattttctttaaaaaaaggagtccttaattttttctaagaactccaaaatatgaaagtagaaaaaggcagctatgactgaatacatttcaagaaaaatgtcattcatctttcttaaattgatctgctgagtccagcagaaatgtctccaaggttttctcgtgacgagccaaggctaaagggatacacggagccagcagttagaggcatctagtggggcaccggttaattaactttttcttctatgcttcaagtttcaatgcctataccaataccttttgttctttgcataggatattatgcaccgaaaatgaaacaatactcataaaaacagctaatatttaatgagcatgagtaattgccaattgtgattctcaacacttggcatatatcatttcattcgtttttaagtctactctatgagataagtagcattattgtgctgattttacagatgcaaaactgtggcccagagaggtcaatagaatttcaggtgtacagatataaaatattcatgaaccataatatcctaactatggtataaatataatatgccataaaataggcacgtggtaagtgtttgctgactaaagattgaagaatgtgttgtaatggagtctattaattaaagacagggaatttggacccagaaagatttggcttggtcttatattggccatctactaagacagtttggaaactttatcaataaagtttctattttagagaatatcttagtttgggttccctaaatggaggttctgagatgaagcttcatgcaaaaatgatctaatgggatgtgttttcaagaaacactggtaagggaaaatgaagtgagattgggaagggaaacagaccaaacacatatatggcataaaagcccagggtggcagtgccattcacacttctgaatttctcagttgggaacaagaaagctcacgtatttatgtgtctgcaaccagcagtcattgattaagggcttcccacacacagggacataaattccaggatagatccatctctctctttacacagaccaaataggctctggcagcctcaaggccaccctccaacagagcgattagggagctagttgttgggagtaaaagcacagcagggaaaatgttaaacggatgtgaaaggatatgagtggatcaatgacagcatctctacagagaacttgtttcttcattcaggaataaaaataacgtggaaagttatgaggataaaacagggtaatgtgttcaaagcccttagcctgggcactggcacacagcaacactcactggcactctcttgttgtgaggatggaatgtaatactgtgaagaactgacagcacctggcacatgaaaacatcagatagctggcattgccaatcatttttcctattgcagttgccggtgccgctggtggtggcatacctaaattagaataacactgctatatttaactccaaagtctgtaaaatgcttgaatacctgccaccgtctgtggaggtgagggtgctcgttcaggacctgaacaccatagaagaagcaattttctcaccatctttattgctaccatggtattaggtaagaacctcaggatgcaagaacaaaaggcagcaccttttttgctatcacatatgagatgctgaatttattgataacagtattaaggagaatggcagctgaaaggaaatttctgatatttctttcatgatcctcccagattttgacattcctttcaaaattattagtgagagcaatcagtaagtgtcttctgctaccaaaaatgtgagcccttgcttgaaacatctttaggtaagtaaagtcagcccctaggaaagcacttaagcaaaaggctagggaaagagagctatatcaggtccaaactaccgtgctgctactcctcactcttggaagaaaatttaggcctttgcaatgaaaattaatggagaagcacatgacacctaaatgttaatattaagggaggggatagggagaatatgatatatttctctatgtgactccatcctgtttcatttgttctagtgagtacatattactattatactttgtgtgtaagataaaagaaagtttaaaaaaagaaaaattgaagttattttagaacagatcaaactgcttatgagaggcttactaccttttaaaatattattttgattaaactaaaaataaattcttaaaaacccagccaaggtaagaaaagaaaatagttttccttctcatgctctcaaactaagagtatacataaattggctaagaaacggataggatgactcccctttttccagggacaagagtgggtttaggagataatccagttctctagttatatacttgtttaaaaaccagatgaggagatcacttcctcacccgtcttttgcctctggaggcaaaaggtatggtcagagttcagtgacaaagtgacaatcatcaagggagtttagtcagctgaggttatgtttctctaggcattcttatacagtcagaccatgaaacaagactactgcttccaggaaatgccacaatacctccttattatttacatttctggaagcaaaggcagcagaatttagccactggagtcctctccactgtcttctctagtacaggtagttcctgaacattactccaaatctacagagacccttattgacagatattacagagatactcaccaacatgccagcgaaacatggtttattgttttttgttttttattggctattgtagttttacttatcctcatctattttattagggtcttgttgagtcttcactatcgtgagcacctcagtattccttgtctccagaaagaaaatgtcttgaggttagaaattgtatgtaattaattaattttctcttccatcttaaaaaagatggctgttaattctatactgacatagtatctaataactgcttctttatatcttggagattttccctggcatattcaaataaatagctgtttaaatagccctgacctgtgagtatatatgcccttgtacacatgaatgtatatgtaaatatgcaaagatacaaaatgataaatacaaagtgaaaggcaaattgttaatatattttaactcattcaacagaagaaagaaggcaggataacttcctctataatttcaggttttcttcaggatgcataccacatatgggctacattacaatgttccctccaggtagcaaatatgttcaattttaaagtagacaactgtcggaaattgattttttaaagatggggggtgggcgttgagtaaatctattatgcttgtatattgcaaatgctgtaactattatttttttaaaagacttgactttcactaacaacaaattttcttctttatatgaatatactgatctcccatcggatcatagtgttggacagttcctaatgtaccttgagataagagatgctcaagggtttcattagatttttagagagagtaaaagccaggctgaaaatgttcctggattctatatttgtctcttcacttatctttttaataacactcacacacagacacatttttatactcaacttcaaataaaagtatgccctgccctttcttttgctgataataaatatgtggatggtatagtctccagagagcgaaagtgcccttaaacatttgttttaagatcataaaaactactgttatttttaaagtagaaaaatccatgaatattgaaattgtaaaatcaagggaaaagaaaatagttttaaatattttgggcaaaatcttcttaagaaaaagaatgtcctatttccaatgactctggcacgtttaaacataggaaagaattagaaaaacaattttagtatattttggaccctttaaaatttaagtaaaacattaagatgtattttatacctttactttgaatatgtgataattctcctttactccatagaatacaaaaactctgcaaatatcattatcttaaaaatgtatttgtatatatgtgttaaattgaatctttctaatgaggaaagttaacgttcactctcaggttgttcttatcagatgagtttgtagttgtattatgaagaaacaacacattccttactgacgtctctattagcttagttatttcagttgagaacaagggaaaacataagaatggtattattggagtgtattgctatacattttattcacatcacagtattttatatttctctttttttaagtttgtacacagacaatatctctggaattatttttattaagggatatttaatgattaaataagcactcttagcgaagacctttaagtgttattttttaccaaatcgtatatagcttccacatacaatgcaaacattccagtactgcagataatatacaggggtacacaggtttgaagtagtggagagactgatggaccataagccataaatctttttaaaaaaatcaccaaaatctcagctataatcttgatcatacaaaataaaaagaggagctctaaagaaataaagcaaaaaaaaaaatttataatccacattactgcaatcatctagtttgtgaaagaagagtatgtattttaaattaaatccttaatgatttgatattttgtttttggaacttcacaaccaagactatcctaaggaattcagagctttcctcacaagaccaaagcaacagtgcatgaaattgaactcaaaaagagccaccattctgtgtgacttcttggctgacacaatttagatatttatagctttacgaatgggccactggagaagaacttgaagctttctctagccaggaaggattaatgaacgtgcgcacctggtaattacaccactccatcttcctgaaagccctcacgctgcctccatggcagaaactataatgaaaatgcattgaaaaatatcaatctgcaattctacaattaaatctaaataataaaacttggtatcttttctccccacacattccagatgtgataaaacacagacagcatttaaatttaaaacatagaagctgaatgtcagcctatttttgaacatgcctcatttccaaagtaaacctcacaagagaaaaaagaggttattaaatacagcaaaaaataacaacattcaaatgtgcaacagagaacccataactgttttccctttattaaaacacagcatacaccataagtgatgcatttacttcaaagcagaggcatttcaatgattaaatcacaaccgaagtgtacaaaggtaaaatttagaagtgcaaaggtatctttatcttccaagtccagttacttgttctggctattttttctaaactcttactgaaaggaaaacctcacttaataacttttaaaaatataaataaaaaataaatcattatcttctttacataaccgtatgttaattgcaaaattacttgaactaaagagatatacgatgacatagtatgcaactcaaataacttgttacaaagaaattttcatcctaaaacttgaacaaatcaaactttttgcagtagtatttttctcagataaaacacagtatagaggttcaacctagtgtttcttaatgtgacacaaagcaatttgatattccaaggaaggcagctatgtatatataaactgagaaggctgctttcagaaaacaatcaaggttctctaagcaaagcagggttttatgataaagtttcatggtactcacactgaattttaatgactgctttagtaaagcagaaagagagaaaatttaatgtaagcactgatactaaaagttaattgccgtcttaacacacaggcgccaagattcccctagcaggagtctcttaaaaaacacctttaaacgcagaagagggcacaagctttgaaaaaaaaaaaaaattgcctgttactgttaaactctattgttccctgatggagtatagaagaaagaaatgctccaggagagggaagtggatatgaattgccccctccagaggagccaaacaaattggctgtaggaagacttcaaaagctggacgaacagagaagctcaaagaccttacagatttgggctacttgcccttgctgtgttttttttttttttttaatttcccctagaatgaatatggtttaacttgagagcaaataatggaaggatgcatttttaaatgctttgattcccagctttttattctgcctctaactagctattacaataccacttaatccggacctcagcattccaagtaccaaagcatctcctcccacccactgctcacacgctcctgcatcagaatagaagacttacagaaaagctgccagacccacagaagagcactttcctctcaacagatgtcttccagcttttaggcacacacacactcagacacacttgcctaccttaataaggtgtgcaaaaacctctttcggtccccacggatgcttttagttcagagcagccagcaatgcctccgcacaaagctttgccattgctagtgtgaagagaaagagctgctgggatgctgaatggcacatcagccaactttgtgtgtagcaaaggctctaaagaaatcctgggctgaaactctgctggatcatggattggactcaatttcactccacacacagtctgcattacctgatggagattatttctggaagcacttagggcatgtttgtctacaaaaagatagggcctttttctttccttaacaatttaaaaaatacggtaacaaaccagagacctgatactttaaggaagatcatttattgtgagctccatgagggcctcaatggtctgtttcgaaattgcagccccagcatctagaacacagtcagcacttgataaatatttggctaaatattaaatgctcaattgatatcaggttcaaattagaatttgctaaattatttacacactgtaatgaaagtaaaaaatgcaaggtttgctgaacagctccagagggttaataagagtgtgtgtgtgtatccttttgtcattcaacacacacacacacacacacacacacacacacacacacacacacctgtatagctgatgataaatatacattatatcaatgagttaaaataaagtgtgctattcattcactgagcaatggggctattgcctgggcacggtggctcacgcctgtaaacccagcactttgggaggctgaggcagatggatcacaaggtcaagagatcgagactgtcctggccaacatggtgaaaacccgtctctactaaaaatacaaaaattagatgggcatggtgacgcacacctgtaatctcagctactcgggaggctgaggtaggagaatcttttgaacccgggaggcagtggttgcagtgagccgagattgcaccactgcactccagcctggcgacagagcgagacttcgtctcaaaaaaataaataaatttgtaaaaaaagatttaagcaaacccactgataacaatacttagaaagtttgttgaaaaccgtatgtattatttgcttattgccctgacaatttctaatatcataatagttcattataatagcccattcctcagtgaatgaatagcacacttcatttgaactcattgatacaatgtatatttatcatcagctgtacaggtgtgtgtgtatacgtatacttttgaatgacaaaaggatacacacacacacacacacacacacacacacacacacgcacgcaattattaaccttctggagctgttcaccaagccttgcattaaacctggattgaataaaagactcccattcctcaaggaaattttacttcttctatgaggacttctcagtaaccctaaattcacaggcatattctttacatgttactgtcccaaagcaaaatgcaagctggcatggaaccaagcccagaggttaattcctgaagctagaggaaaaggttccaaagtgccctacatcccaaggtcgcccaacagatccacacctggaagcaatctccgccaagcgcctatttacaggcacaggtgtgtgcctatcgggacagctgaggaacacacctaatttgatagatgacattctgatgtggcaggctttattgtgctgtttatgacaatatctgcagattatgatgtgcttgtttaataaacagcgtaattaagcacacacaaaacaaaacaggaagttaatacctaagtggtgctgacgtgtttatgtaccacaactgactagtgtattctttactgcctattactccacttcttaatatccactgaaggaatcctcagtctgtatacacacatctccaagttatgaacatcaacttcatgcatatcctcagaaagacctacttacacctgcagcctcaccacatatatctacacccttaacaggcattcaataaatacttgtcaaatgatcagataaatgataaatgaaggagaaacataccaatatttatatcttcaagattgctcctatgggcatataattttacaggagttgctacttggattgtctatcttttcagtctacattttttctctaaaatataattggcagttgccttatggatagattaaatttgatagagcctggtacttgaggtgctatttcagcaccatttctgtaattctggaactagttatcaggcttggcagatgcaaatgtatgcagttttgatcttcttcccgactctctaactgcagattttacaactgaagaaagcaaggggaacttttatttataaataatcgatacaatttgtaaatagaaatcctttccctctgagcagctcacagccagccagctctcagatgaaggtacgtcagctctctcttgactaatggtgtggtctgcatcatggaggttaccagacattccttggcagaatgcaaatcaaacatcttgaatggcaaaaggatcaaagcacggcatctaaacattgctcagacctgctgttcatatttttatgcatcagaaaacttgaaagagaaattagaattgaaagataatgcacctgcaccttccaaagtgtataatattgagatttttagcatatttgtccctctgggattagtatattttattccattgtagggcagcagctgaacaggggtttgtggaggcagaagacttgagagcctcttggctcaactacctgtaagctgtttgaccttgtacaagtcatttaaactttctggcttcaacttccacatccataagtggaattaataatacctcatcaagtgatgagaatggaatagatattaaagcactgctcctcaaaatttaatgtgatacaagccaggtgtggtggctcacatctgtgatcccagctacttaggaggctgaggtgggaggatcatttgagctcaggagtttgtgaccagactcggcaaaatagcaagaccccatctcaaaaacaaataaagaaaaatgcatcgaaagtaaagaaaaaagaaaaaaataataattgaatacaaatgaccttaaaaaaagcagagtttaattcattggacctgcggtggtgcctgagagtctccatttccaataagctcccaagtggtactgctgctctgtggaccccactgtgtgtagcaaatatcagtggaaaacactgttattcttccaaatgatagtgaatttgtgtcctattgccatttttatttggtgcatgttttccctcagtatctacccaaccgtcaattactagatgcttgtctacggcaggtgatgtgcaggacatagatattttaaagtttacaaagacattgccctgtcctcaggaagctttcaatctatgtgagaatgaagatcacttaccactacaaacagtttggacatggaggaccaaagctacctaccccttatgctcacatagctggctgtcgacattaacatggtttacctttccattgtcttcattagcataactttcctattacagataactcttggccaggcaaataatttgactgttcactaaagtaacttccccaaactcccatcaactcttcaacaaaaaacatcaatagagttcacaccttaatagtctctgagcctcttggctagaaatcttcactgtgctgtttccaccaaactaagttgtaataccatgatccttacccaatcctaattgtgcccccacagtgaaagaccaatcttaaaccaagcttcatactcccaatgaaatccaacctcacctttctccttatgaaatactaccaaagctttgtccaggctgtggtctttcttaccatagtaagcaataaatttaactttgtcttatcaacaggttgtattggtgatgtttagggagctgaaatttcccatatggaagaaatagacatgggaatcaaacgtatgttacaaggagataagcagtggtgccaaggggtggattaaaagactctagctccttttttgtcataacaaataaacatccaatttaattataatcagtacattttttctctgcaaacttagtttaacaacaagtcccctattctcctcttatttactcacccaggcatttggatgttatcactggtgccatcattgattgtgataaaatatttgataagttttatgtcctcaatgcttcattaacagtataatacatgagagtgacattaaccaagattaagggagaaggggaaatcttttggtggttgtgatgtcaaacctaaaactacatggaggcccagaattagggaaaattcagcatccagacagacaatgtaagatcacggtattttcagggaaaaacatgaaccggagcaaaagctcaaaatggggaaagagcgagagagaaactaagggtctaaacagtcttttatgtcaagttaagtggcttatgtctttgctacccaaagtatggtctgcaggccaaaatcattgctataaccctgagcacttgctagaaatgcagaatctcagacaataccccagacctactgaatcagcatcagttaattaagaaaatccccaggtgattctgatgcacatcaaagtttgagaagcactattcaaaataatatgctggaggctacgggaagctactgaaggattttaagaagggaagtgacataattgaatttgcattttagaaaaaaaattactctgtgtccattcattccttcaggatatatatgccaagcattgaccttagagctggaaattcagcactattttgagtggattagctgaaactccctattcagtattcattcaatgaacatttattgcattccaactttggttttttttttttttgtttgcgtgtttgttttttgcttttttgaagacagggtctcactctgtcatgtgggctggagtgcagtggcatgatcccggctcactgcaacctctgcctcccgagttcaagtgattctcgtgcctcaggctcctgagtagctgggattacaagcatgcaccacaaaagccagctaatttttgtatttttagtagagatgggggttttaccacgttggccaggctggtctcgaactcctgacctcaggtgatccgcctgcctcagcatcccaaagtgctgagattacaggcatgaaccaccatgccccacctgcttgcaaactttcatttgacttttccaaaagcttgatttggaaataatcccacactgatggctatgtttttaatggagtcaacctttgttgtccaggacaaataactgttaagaatcttctagcatactgtactcaaagtccttagcactatcaggctgttggctcaaacatgaaaggtttttttgatgtagttttgtagaattgttattgcaatggtatttgctgtattggaatttgacccacagtacaagttatagtacaagataccaatcaatattgttttttgttaatgaacaacataagatgtacagcttgccaaatctaaactttaatattagagattataggatcagtaccattttttgctaacctatgcagaggattgtcctttggtgactgaaaaggaaaacaataaattcctacttatgtggagtctctgtctttttaataatagtcagtgtcttattggaactcacaaagacttggtgtgaagagctctgacaagctagttagcctattttatgcttgttttattcttgcttcctatatgcaaacatagtgaaggacagcgggcaatgagctcgcacttctattttagcgattctgggttactcgggctgcctctaatctaccaagccaggattattataaggaaaataaccaatgtagctaaagataaagtcatcacttccctaactcaattcctttgtagctgcaggaacactaaatttcattcagaattctaactcccaaaaagctgggtaatctaagacccttaatggttttcttatagcctcatagggtttggcaggtgccctggacatctggcagattccctgagagaacaaaaactcagaagctaccaaagattgaaatactcccttcaatacccaccaactaggggagcttatacaagaccgtgggtttctttctactttgttcttttatttacataatagcaatgataatatctttgttgtagaattactcggaggattaaatacaagaaaatatttacagtacctagcacttaataaactctcaatatatattaattttccccactcccttctgggttactaagacccctataaaatgcaaatttatttacatcacagtagtcactaatatttttgaaaagttgagttaattgaattaggaagcctgttataaagaataagccctgagtaaagaggatgtgtattatgttctctaaggtatgtgaagtgtgtgaaaagaaggtccaaaaaaggagggcttgcttgagatgactgatatccaagaagatagtacaccctagctgtcagaaccattgactttaagggctgaagatatcataaaactatccattttgcagatgaggacactgaggctaagttcggtgaaataacttgcctaggccttagagttagaacactagcaaggcaggattgaaacctagtgaatgagaggcttcaaaaagaaagaaaacaatgtggacacagggaaaaggtgagggagagcattaggacaaatacctaatgcatgtggggcttaaaacctagatgacgggttgatgggtgcagcaaaccaccgtggcaaatgtatacctatgtaacaaacctgtacattctgcacgtgtatcccagaacttaaagtataataataaaaaagaaagaaggaaaacaatgtgaagaatgaaagcaggatagggaaggagggagcgctacagctcagggtgaagtcttgtatcccctttgcctctgtccccttagtagtaaatatttctcggggtgaatcagtaacatccctcagcctctcatacagaagtgccagagtgtgatctggctattctgccattaaacattcaagatcctctacaaccatgaacatagaagaatgatttatccttatgttcttgctgtatcaaagactctcagagattttcagagacatgccttttccatactgatcaatgaagatgggtcaccagaaacatcgtagtcaaagtgacagtttttgtactgccttcccagataattttacagactgacatgaatttgaagcaacaagcttttttttttttttttttttttttttgaggcggagttttgctcttgttgcccaggctggaatgcaatggcacaatcttggctcaattctcctgcctcagcctcccaagtacctgggattacaggcatgtgccacaacgcccagctaactttttttttttttgtatttttagtagagatgggggttcaccaagttgatcaggctggtctcaaactcctgacctcaagtgttccacccacctcagactcccaaagtgctgggattacaggcatgcaacaagcatttttatgaagaccctgcctgaatagccattcattccaaggggacttgaatttgaataatacctccacacagatgactctcaaatctgcatctctagcacatacttcttccctgaatcccatactttcatccaactgcactctttgtgactttactgggatgtctaacaagatttcaaacctaacaattccaaaacaaaattattgcttccacctttacccctctaccatctaacttgatccttctaccattttctcaattctattcaccttatccaccttggactcatcctgggctcttctctttctttcccaccccataccccattcatcagcaaacctggtagtgctaccttccaaaaatacccagaatccatgtacctctcattgttttcactgaaagcttcctggtttagaatcaccattatttctcatttgaattattgcaatgactccctctgcttcaataggtactcttactctctgttctccactccgtggctagaacaattcatctcctttctttccccaaatgagtttacttagaaaactcccttgaaaagacaaaatcatagagatggagaacagattaggggttgctagtgattcaggaagtagaatgggagattggatgggtgtgacaattaaagggtggcttgagatagttcctttgtgacgctggaactattcagtaccatgtatcaaaataggggtagttgttatatgactctaaacatggtataaaattgcatagaatgacagacacagataagtgcatgtaaaagctggtgagatctgaataaggcatagattgtgttaatatcaatttcctggtttttatattgtgcatagctatgtaagatgtgagatctgaataaagcatagattgtatcaacatcaatttcctggtttcctggctttgatattacatataattatgtaagatgtaaccattagctgaagatgagtgaagggtactcatgatctttcttaatacttttgcaacttcctgtaagtgtatatgtatttcaaaataacaagtttgaaaaatactgcatatacacggcattcctcaagactacggattttctgtttcttctacctggaatgctctttccccaaatatgtaaatggataatttctccccttccttgagatttctgttcaaatgtcacctcatagaggtctgcccagagtgtcatacataaaatatcaattttggctcggcacaatggaccatgtctgtaatttcagcactttaggggtggaggcaagcagatcgcttgagcgcaggagttaagaccagtggtactgaggtagtgaggtactgctataaagatacttgaaaatgtggaagcaactttagaactgggtaataggcaggggttggaacagttaggaggctcagaagaagacaggaaaatgtggaaaagtttggaacttcctagagacttgttgaatggttttgaccaaaatgctgatagtgatacgaacactgaagtccaggcagaggtggtctcagatggagatgaagaacttattggtaactggagtaaaggtcattcttgctatgactaacaaagagactggcatcattttgaccctgacctagagatctgtggaactttgaacttgagagatgatttaaggtatctgacagaagaaatttctaagcagcaaagcattcaagaggtcacagagcataaaagtttgaaaaatttgcaacctgacaatgcagtagaaaagaaaaacccattttctggagaggctggctgtagaaatttgcatatttaacaaggagcccaatgttaataggcaagacaatggggaaaatgtctccagggcaagtcagagaccttcattgcggctcctcccatcacagacccagaggtctaggaggcaaaaatggtttcgtggaccaggtcccccccccaaccccaccactgtgtgcggcatcaggacttggtgccttgtgtcccagccactccagccatggataaaaggggccaaggtacagttcggaccattgcttcagagggagcaagtcccaagctttggcaactgccacgtggtgttgagtctgtggatacacagaattcaagaattgaagtttgggaacctctgcctagatttcagaggatgtatggaaactcctggatgtccaggcagaagtctgctgcaggaatgaagacctcatggagaacctcggctaggacagtgtggaagggaaatgtggggttggagccccaacacagagtccccactggggcactgcctagcggagctatgagaagagggccactgtccaccagaccccacaatggtagagcgatcaacagcttgcaccacgtgcctggaaaagctgcagacactcaatgccagcctgtaaaagcagccaggagaggggctctaccctgcaaacccacaggggtggagcttaccaagaccatgggaacccacctcttgcatcagtgttacctggatgtgagaaatggagtcaaaggagacaacttcagagctgtaagatttgactgccctgatagattttggactggcttggggcctgtagccccttcattttggctaatttctcccatttgtaatgggtatatttacccagtgcctgtgcttccattttatctaggaagtaactaacttgcttttgattttacaggctcacaggcagaacagacttgccttgtctcagatgagactttggacttggacttttgggttaatgctgaaatgaattaatactttggagtactgttgtcaaggcatgattggttttgaaatgtgaaagggacatgagatttgggaggggccaggagcaaaatgatatgtttgggctttgtgtccccacccaaatctcatcttgaattgtaatccttataatccccataatccccaggtgtcaaaggagaggctatgtggaggtaattgaatcatggggttggcttcccccatgctgttctcatgatagtgagtgaattctcccaaaatctgatggttttataagggtctcttccccctttcctcagtacttctccttcctgccaccttgtgaagaaggtgcctcgcttccccttcattttctgccatgattttaagtttcctgaggcctccccagccatattgaactgtgagtcaattaaacctctttcctttataaattacccaatctcgggcagttctttctagcggtatgaaaacgggctaatacactccctctcttgagatttctgttcaaatatcacatcaaagaggtctgcccagactgccatatataaaacatcaatttcggctgggcatggtggttcatgcctgtaattccagcaccttaggaggtagatgtgggtggactgcttgagccccggagttcaagaacagcctgggcaacacagtgagactctgtctctataagaaaagaaaacgtgttagctgggtatcgtggtacatgcctgtagacctggctacttgggaggctgatgtgggaggatcatctgagcccagggaggtcaaggctgcagtgagccatgatcacgtcactgcacaccagcttaggcaacagaatgagaccctgtctcaaaaaatatatataaataaaaaataaaacatcatgttcctgtcactttttccctatcttgttagtttctcttttcttcttaacactttaatacttccatttgaaataccacatatttattttctcctttcctaacttcccattactatatgagctccttgaaaggacagcgtttgtctgtttttggttatccttgtgcctatattagtatgtggcacacaatagtcactctacaaatatttgatgaattaataaatgagtgaacaggtaaagctagtagaaggaacagtcatgcagattggcttaataggaaatacaagtctgacaaaatcacattccttggcagtacttaaaaaaactgggaaggaaaaagaaaacttgctcctgctgcttctgtgatacaaagaaaaacctcattattagcagtttttttaaataataaagttgagcattaccatgtagaatggtattatggacagaacacaccacatatgtataaaaataagtaacttccctgggaagaatcaatacagatagtccctagattacaaatgagttgtgttctgcacatttgaaagacagctgcttaatgatctgctcgatgctctctaaattttctgaccgggttcacttcacccctacctgtgcattcagtcatactctattccctggaatcaccaaacctgtacctaacagaggaattcaatgtggttacatttcataggttagtccacaaaataatagttcacttataaacgagctgaagtatagtgtaaataatgctggttttaactctgcacgttgtaagtaattcaaatgcttagagttgtatcacatttaatggtatatttacctgagaaaggcaatattaaacgtgcaaggaaatgtgggccttgaagtcaagtacactttgaaatcaaactgtcactctgatgctacctttgtgatgttggtccagtttcttaacttcttgaagccttaatttcctcaactgtgacttggagatgatcattgagactacccaccaggattgttttaggattaaaggagataagtcttcagcacagacttagtgttccataacattacatcttattatattgagcacttccagttagtctgagttacaaatgatattttacacatcatcgtaaaccaacggtctaacaacgtccctgatacacggttaatgctaaatatgtgaggtgaatgaatatttaacaagtacattgattcacatactggagagggatgaataggcatgaaggacaggcacgaaggcctttaatgtttgtgagcctatccatctatgatgttttccttttaccttcctcccattaccttctaattctctactcacaggtttgctaaaagatctctcttccaccaccactccttgtccccacagtgggaggagcatgagggaaattcaaaaataaataccacttatgtagcattttttggttggaattttagggtcaatatttagttttaaaatgtgttaaatgtacattttcattaaaaagaaaagaaaacatgatttatacaagataagcatgacttcttcactgctgcatctttttgaccttagtttatagaatctcaactgcagcctggggcctgccccatctctgaagaccgtgctgcccaaaggatgaggatatgaagtaccctgttaaagtaattcattggcatgactgcttggtttgtcctggattaatcatctctctcaaggagattttagcccatcggcccattcctgtgcaagatgcctaacctgattcctaggctcccaagctagaatgaagatactagctacaagtcctccccaatgctagactaacatacaattttgatctctggaattctagtcaatgatcctaccaatgtgagctctacctcttcatggcccctaaacgctgatatctgctttcagccttaccatataatgctcttatgctcttcctcttgaaacacatgttaagaatgacccatcttccctttggaagagtttaagcagttttcataatctctttaaaaaaatttgactggcatcaaatcaagctctgaccaatgacagttataaaaaaaaaaaaaaaaaaaccaacaaaaaaactaaattccctcagagaaaacaggaaagtatgggagcaactttaagaaaacacttggaataataacaaactgttacttaatatttaacctatcttttccccgaagggctcaagctgattattttcttgcttttgacggctagtgaaaataattggttcctctcttctttgtcacctccttgaactattaagttttcccttgatgttttctcatgcatgaatatgccagtaccacttacacaggtcttgtaaacaagtttcaaaagctattagacccacataaattacacaaaatatgtttcagtccctaccaaatttcctaaagccatagttcgtctgtccacatcaacccactcccttcttttattatccctgctttagctaccttgtcactcaaataaactgtgtaattcacacctgctttgagctgattggttgatctgtccttgattgtcccaggtggatttattctcccttaagcttcaggtaggaatcctgcaggttcatacctggagaaggagataaacctatgccttaaatgcaatgttcattaatggataaattcataactggcaatggtaccaagagttacagcatcttcctctattaaaagcagagcagcctatgggatggccaagtccttgaaggtgacagggatttgacaaaaatggagggtatgaatgggctatattatagttaatgatttgaaatcattgtttagaaataattgcctagacaagataagttaactgatctctacaaacttgcattatatatatttctcatcactatgcataatttttattatagatttgtcccttgaggtccagaagcacaaagcattctcatagtcccccaacaggcatctttctttaagagacaaagcaaggcaataaaaggggggtattttatttatcgcccaattcacagcatttctgtcttgactctgagaagtgtaaattcataacaggaggtttctagacatacatatagaaggtgatgctggtgatccaaaaaatattgacaattgataaagaaatgctgaaggaggtgtcactattactagaagtaaaagttttaacaataacaataaatgaggcctctttctgtgtccatctgtccacaatcccatgccatctaccccttctctagagttgccatggaagagaaagttccactacttcagttacgtcatttctatttggaggaaagatgggggtcattttttctaattgaagagtgttgtgacatttttttcctcgcattgtttcatttcatttcgacttatcttttttcccacttataatgtgcatattattttttgacatcaagataatgacaataaagaaaaaaaactcactgtcttctcaattttaaaagaaaaaatagcaaggaaaaatgatcagctaaaggatttaattttaatgttgtgataagctatttttctaaatgattttccacataatctgtgctttagcaaagatcttctcttttttttctagtttccatctgagattagataatgggctgtatcccattatgtgcatgctgtaactccaccacacctgttacttttgacatatttttatatttctcaataattaaaaaagaaagagtgggccaggtgtggtggctcatgcctgtaatcccagcactttgggaggctgaggtggatggatcatctgaggtcaggagttcgagaccagcctgaccaacatggtgaaaccccgtttctaccaaaaatacaaaaaattaactgggaggggtggtgcacacctgtaatcccagctattcaggaggctgaggcaggagaatcgcttgaatctgggaggcagaggttgaagtgagtcgagattgtaccattgtactccaacccgggcaacagagcgaaactccatctcaaataataataataataattattattattattactataagaataaatggtagcttatttttacctaaacgtagtagtggcttcatgccacagttgctaatctctgagccatctcactatcctttgttcagcttgttaaatgtctctatactttcgtaactagttcctcatagtaaattccttcttccagaccagtgtttcccaacctcaccacaactgacattttggacagaataattctttgttgtaagagactttcctgtgtcctgtacagtgtctaccaatatctctgtctctaccaaatgaataccagtaacactcctgcaattgtcacaaccaaaaatgtctccagaaattgccaatttatccctcagcgtgcagcagaatcacccctggctgagaaccactgtattagactagaagatctttacttttctgactgactcctaagtgatatactcctttcaagcgcatatttatacctgttatatgtaaaaataagattggaataaaataacatctatctatctgtgtccctataaaattagtcatactgtggtgatatctacatctctataaaactagtaatattggtaaacaataaaagcttattcagcaaatgaatatattgatatgaaaagatctgcaaaaccttgatctactttttccaaaattaatacatattttattttgtccagctaatatttaatatatttttatttaattagccatcatagggcctttgaaatagttcatacattatgatgccttatatactaaagtgagtaaaattaaacatctgttaatacggctgacacagaaaaacacagtcagataggcagttttagagaggagaaatatacaataatagttcttctttttcccacctcacattatgaacagggaagtttttccttagcactaacatctcagcaatacgtaaagatatcacatcccttattttgtatttattaatccttcttttaatgcttctgttgctaattttttaattgactttgtccttaccgaatactagtgataggatttataaaggatgattaagtcatggactaatttaaactttgttgaactcatataacagtgagtttcaatgaaatcacactaagaattctctgtaatgctttgttccagctataagaaaacaatacccaatttcatctaagagatgaaaaataaagaaagtatgtgaagataatcatattcaatagttattatattatgataatttgcatatgtagacatccttgaaatgtacatagacctttattcaagatctttcccatacatttcagaattcgtttttatcattcatacatttgataaacatattttaagtgtaatatttatcttatcaacatgtaatgcatacttaacaatgtgtaatattgatcttatcaatgctactctaccaaaattaaaagtagatcattaaagaaaaaaatcaaattcctcttaatgtcatagaaaaacattcttctctattaagataaaggacaacttaataaatctaatattttcatagctcatataaagaaatatagataggattagacaaatagaaggaacaaatgaaagcccagtagattaccagtgttttgagccttaatttaggaagttatcaaatatgtacttattcatttcagggaattgtatggtttcagaaataagaaaagcgacaacaaaacggtcaaatttgcctgaatgattggtcagctttgttcattctaaacttaataatcctttactaattcagcaaagtcttataaaaaatttatcaggtcattgttcataatgatatgagcaaaaaggaaatggaaatagataacaggtcatatgatggatttcattcaaatgttataaggcattttgtgttaaatatttgtcattcatattacatagaaatataatttatgtagaggaatgtaataaacattactctttttaaaaacatcagtttccgaatatgccacagaatcttaatttgattgaaatgccctccctctcccttctctcaacagtgagtcttattttgtgttcaatagcaactaaatgtttccagactgtgaagcctttctcaagtcccacaacgggagttatatctgtcacctatgatcccacagcaccctcttcatcctctattataaaatactaccattttagacttatactctatagtgttctgattttgcccatatgcctaactcacacatgagatcactaaggccagaaaccatatgttattcaattttctgtttatgtggccagttccttacaaccttgcttatataaagaggacattcacaacatgtttataaaattgaattcagctgaaaatttttaatgagtttgcactgagaaatgagataaaacttgaaggtatttgcatgataactgaaaagctgtggatcaaatcaaagatcatagaggtatcttggaatacaccacagtttggaggtatcagaatgatctggctaagtatttgttgcagtataggattttgttttaaggacattaactgctcaattaaaaaaaaattggactcaattttattttcagcttgtgatacctgattttggtgtgtgtgtgtgtgtgtgtgtgtgtgtgtgtgtgtgtgtatgtgtgtacttttacattttcagcagcatgtggcaggtggctttttagggtacactattcctgtgacctgttgacgtgacaaagaggtcgttggagaaaaaaatcactcctcatgagtacagtagtatcccaagagaggcagatcacactcacacatgacataagaatcaagttttactgaaaaatcatagaggtgtttttagtaaagcaattaagaaaataatctttttcttatatatttctgatgcttcctaaaaattattattatgattatgattattattgagacggagtctagctctgtcaccaggctggagtgcagtggcgcgatctcggctcactgcaacctccgcctcccaggttcaagtgattctcctgcctcagcctcccgagtagctgggattacaggcatgcgctgccatgcacggctaatttttgtatttttagtagagacggagtttcaccgtgttagccaggatggtctcgatttcctgacctcatgatctgcccacctcggcctcccaaagtgctgggattacaggtgtgagccaccgcaaccagcctcctaaaaattatcttataaataagactaatcaattaaaatattttaaagatatttttcttctaactatacttccaaatatttatatgtatgctttaggaaattgagtttttaagtgaaatattaaagacatctcattttcctgttacctgattactgttcattcaacctgttgctgtattgttccatttttatatgatataccataagaggctatgtgtgaataaggcaatatacatgatgcagcattactttgtattcacattttcaaggtgtatagaaaatttttaaaaagatgttaaaaaggtaaataagttcattgttaattgttatagaaagagtagacaagagagaagactgagtctacatttcggcaaaaagtcttcataaaaattagaaaattggtgagtaagtcaatgaagcattgtcaaagtcacaaacaaaaggtgactccacattattataattcccctgtcagaaagtagacatggcaaacttatgacttcaacctctgaaaatgaggatcacagaggagaaataagactggacaacaggcttccagctgtgtttctaacaagtataattacactggttggacattatcattaactacatttctaattcttctcataattcaaaaagtgagagagaaaaaggaagggataactctttttggtgttatagtacctcattgtaggtttccaaaaacaagtgactcctgacaacaactgttagctctgaagtgagagtctgcaaactgcagccctcaagccgtaactagcccattgccatttttgtaaataaagttttattggatcacaatgacacatcttcatttctctattgtctatgactgcttcaacattctaacagcagagttgaatagttgcaacagagtatagaaaacaaagcctaaaatatttactctctggccctttacgtttacattacagaaaacacttgctaacccctactataaaacaatgttgtctttggaagctatggtaaattaaaaacagaataaaactattgctcacgtatattttattttcaaagtaaaattacttttttccccttctatagatattttttttttttcctggaaggagcttccaatttcaagcaagaacagaagcagaagcactccaataagtgtgcttggttacatgaataacttgtgatggtttggatatacttcctggcaacacgcaatgttagaaacctagaaatatgtctgcctggtacttttaaggggaatatatagagagcctcttttgaaactttgaaaagatttattttctattctggagacattttagtatggagagttgaaggttgcataaaaatacagcaactaagatagttggaatagttattctctagggaaacatttggccctaagacaagacatgttggaaacacataaacaagcaaataaaattggcaaatgtaagttttgattcatatatgctcgtgaaactatattcttaatgctattgagaggtgaggccagctggactttctgggtcgagtggggacttggggaacttttctgtcttacaagaggattgtaaaacgcaccaatcaggaaccttcccgtcttacaagaggattgtaaaacgcaccaatcagcgctctgtaaaatgcaccaatcagtaggattctaaaagtagccaatcgtggggaggattgaaaaaagggcactctgataggacagaaatggaacatgggaggggacagtaagggaataaaagctggccacccaagccagcagcggcaacctgcttgggtccccttccacgttgtggaagctttgttcttttgctcttcacaataaatcttgctgctgctcgctgtttgggttcgtgccacctttaagagctgtaacagtcaccgcagaggtccgtggcttcgttcttgaagtcagcgagaccacgaacccaccggcgggaaccaactctggacacactatgaccttaagtaagtctgtcttcatggatcctagatatttcctagcctttgtatcttccttaaaggttaccttcaggtgcttttgaagttgttatgaccacatgtacagtccttaccttttgtacatgaaactcaacttttgattcctattttatgtttccattagatggctacgtatgtaaacaaaaaaagtttttgtgacactcaggcattactacggagggaggtgaacgttcattaagacatttatctcaaatattgcatccagaagaatgacactaagaataaactcaattgaagtatgagataatgtgcttcaaagactaagggactaaataactcatcctcttcctaattaccttatagataccttagttctctttatccttctccaacatacaaagctagttcatttttaaggtctttgcataagctgtcccttgtgcccggaatgctttgcccctacatcattacatggctgactctagtttgtccatcagttcttcttcaaaatcaccttccaagtgaggtattgaagactttttcaagatttttctcttttttattaattctgtgcataatatttcccactttctaaattgttttcctttctcagtttgtatcctatccctgcttactaaaattacagtttcatgagcacacgggacctatgcttccttgtacgtagtgtgcaggatattacttggaatatagtgggcacccaatatattaatgaatacaatcattgtagaaagttaaatccacagtggtccagatgtggtgttaagcatgaacctaaatcttctaccttcaaggtgctcctaatatggttgggttgatgatcacatacaaatcagataattataccacttgaggaacattaggtttacaaactaagcattattatatcattttattaaaatgtattcatatcagtaaagtggggacggtggagtcaaggaagaagtattgtaggtgacattttagctgagtatagaaagggaggttagggatgaagcaccaggcaaatgcttgtcacaagtgaccttgtgagtcacttgtgacatgaagtgagtcacttgtgacatgaagctgtataacgtgcttagaggaagacatacagttcatcacggtcacctttcgtcctgacatccacattcatttctctgactacccaacccctcacttggatttttcaaaggtatctcaaaattaacacatccaaaatacgtttactctctttctctgcaactcttttcctctccccttatgcatttaaccattcattattttatccaatacgtacttactgatcacttattattttcccatttcaaaagaaatggcagtgttatctccagaggtgtatgacatcagaaactgggaatgatatatgacactttcctcaaattcaactctgcaatcgttcaacttaacactaacccccgtcaattacgtctcctgtatttttctcaggtttgttgtcacattctcactagaactattttagtcaagaccaccatcgcttcttgccaagattacaataataacctcttttgtccattcagatttgcttctctctgaaccattctccacacttcagcgaaagaagtctctgaatcaaagctctaatcatgactctttcctgacaaccacgtgacaaagcccttctgggcagagaaaaaactcccaacaggacccgaaggaccctccaggttctagccccatctcctctttagcttggtctcttgaacatctttcttccaaacataatctgctgtcacattctttctgttcctttatctctgacactctcaggcttagctctttaaatgtggtactctgcatagaaaaatttccaccaccttcacggtagttttgtgtggccaagtctatatcacttcttcacagaagcttttggtgacccagatactaattcaaatttctaactcggacaccagtggttcccctttctctctctctctcaatctctctctctctctctcagaatctcatgagattcatcatggttgattacttgcataaagtctgacatccctgctgggattatgtctgtcatgttcacttctgtatgctcagcatctagttataattaataataataatactaattactgagggagctaaatacttatttgttggatgagtgattgtggtaaaaatgaaaatgaaatgatgtaaaatagtggaatgataaaacagagtgttgaaaatgttgatgagagccagattataaatgctttgagaaatatttcagaggctgtgctgacaggattttggtagagatttgggcaataaagagccagaatggatagggatatatgataactgcagggtttttcagagaaagtgaattataaatccatcagtcaatataagaaatgcagaaagaaaaacaatgttgcggatgttagaaaggattgagagattctgaagtgatgggatgttcaggaaatcgaagttaagatatctagtaggcaagcagaaacctaccttatggccagaacattctctgacccaaaagtctcaagaccattttttttttttttacaactaatgtcaataaactacttttcatgtacactagaaatgatagtgtgaaatatattaatgaggttaactattgttaaaaatcagaatatgcattcctaatatgtgtttgtaaaataaattttattgtatatatttaagggataccacataatggtgtaagatgcatagatatttatatatatagtgtaaaatagttaccattgtggagaacattatcatatctatcatttcacagttacccatttttcactctgtggcaagaacagctataatctattcatttatcaaaaatcttgaatacacactattattaactgtagtcctcatgatgtatattatatcttttaatatattaatatattttaatcatttgtatcctatgacctacattgccccatttcctcacaactaccctgaccctggtaaccactgtttaattcactatctgtatatatttgaccttttttaaaaaaagattccatatataagtgagatcatacaatatttttctttcttggtctggcttatttcatttagcataaggtcctccaggtccatccatgttgggacaaatgacagatcttcttctttttaaggctgaaaaatattccagggggtgtgtgtgtgtgtgtgtgtgtgtgtgtgtgtgtacacacgattcttggaccatatttctttgtaaactgttttctacatattcttagcccttccatagaaaccccagattctctctctctctctctctctctctctctctctctctctctccctctcctcctgctcctcctcctcctgcctacatctctctctcccttcctcttaaagtaactctaaaatataattttaaatattcttattttgtctggtgccagactgttttggacactagccataaaatatttttagctgtgttcatttaagctaccatacaagccaggcgctacatctacagaacacctttctttttactttgtaagttcttttataatattggatgtggtgatgagataaagaaaagagtgaggtataatggtcttcctaggtatcagaattttctttttgagaaactgtttttcttcctttagtaacgaaaacaagagccaacataatgatctgagttctgataatgagtgtgttttggcacaaactgtcacatgaatcaaaggtaacttgaacatgtataaattaacattccacagccagaaaatatttagattcactaaatctgttactctaagcaaaattcaggagttaagtcaatgatagatggccattttggtgtctggatcttaggagaaaataggaccataagaaataaacactgtccttacaaagaaataaacttttgtcctggagttaaatggtaaaaaggacgccccctcaggggagcataccttgataatattgatcatccaaataggatgatatggtttggctgtgtccccatccaaatctcatcttgaattgtagctcccataatccccatgtgtcatgggagtgacctggtgggaggtaattgaatcacggggatggttctgtgctgagggagctaaatacttgtgctgtccttatggcagtgaataagtctcaggagatctgatggttttataaagggcaattttcctgcacacgctcttgcctgccaccatgtaagccatgcctttgctaccccttcaccttccaccatgattgtgaggcctccctagtcatgtgagactgtgagtccattaagcctctttttacttataaattacccagtcttgggtatttcttcatagcagtaggaaaatgaactaatacataggattattgagaaatatacatcaaatataaaatgtgatttttaatgattttttctcgattgatgtctgatggagactaagtgcttaatatgaaaacagaactcatggtgttttcttctgcggaaagcaagttagtgtagtccaggcttgtaacttgctggtataagaaaagatcctagactttccaaagggaaaaatggacagaaggttacatcgtagggtcagcagtttcttagatgtggtcatctggttatagtattactctgaaatattacctccttctaggtttttgataggagtgggattgcagacaatttgaagctctactttatgatgaaagcctggtgagctctaattgagaaatacagacctggtttggatactaaatgagtaggtgtttattaacacactgttaggaaaattgagaattctggcaggttttagtgctcaaagtaaaacctttcccatttacagagagaggtgggcttggagagacccttcagaatgagttgggaccttcctgaagaaggagctctggatccgttcaagcatcactgtgacttctgagagacacgtctctattagtccattttcatactgctataaagaactgcctgagactgggtaatttataaaagaaagaggtttaattgacacacagttcagcatggctggggaggcctcaggaaacttaccatcgtggcataaggtgagaaggagcaagccaccttcttcacaggtggcaggaagaagtgcccagtgaagcaggaagagccccttataaaacaatcagatcttgtgagaactcactcactatcaggagaacagcatgggagaaattgctcccatgattcagttacctccacctggtctctctcccttgacatgtggggattgtggggattacaattcaaaatgagatttgggtggggacacaaagccaaaccataggatccatcaaatcccaggatgatggttctccatccccacaatgtgtgcaatattttaggagtcttttgttactcataatagctaaagtacagatctttgcaagtagtttcatcttccacgagtgaaagcagattcaaacaaaaacattactctcacctgcatcatacgttttcgagagtgagcagtgtgctggaaattgccccaacccatgctgttttatgtaagccatagtccttagaatgtaggtactcagagaagagcaggtacttttttgtgctaggaagaaacatggccaagcaatactgctatctgacgaggaagctgttgttctttaacctggaccattttcagagtaggcattttaaaagctgcctgatgagaactttttgaaactgtagcagagcttccatggatattctgattggatatatcattgcttcctgctcagcttgctaagataacttgaaaacagaaaatccttttgtctggagtaggtatttaattaaccaaatgttaagtattgtgtattttttcagttgcttaagtggaaagacattattacctgaatatagtttttttatgaacaacccagaatattaccgggttaaaggtcattggtttattacttaacctaaaaataattgctttgacatatatggaatattgtatatctcattattttttgataacttcagaagagctaatataatcggaggcagatctacagtggaatagggaattcagaatttatattctaacagaaaaggatacagtaatatgacaaggaaattcctaaaaatatagtatattttccatgtgaaaacatatttccagaccaatttcaaaagaatgatagcttagattcctctctgctgcagtaagctatatcccccacttgaaatacatcccacctttcctataattacctcttccaccagaattgcaattatacatttcttttaatcttttacttttcaaaaataatggaaatttaaattgggaattaagttgcatttaatttccagtttcgcattttaatctttgaaaatagcctagccacaggcaaggtgcagctgaaagcttcaatgacagcacacctaaaatgggaggcctgtcagatttgacatatgaagtggtggtttggcttccagcaaagctttgtccattatgctccctctcttgttcacctctccctctagcttttcttccactgtcagagagctgaaatgcgaataattctactccaggaaacatatttcacataatttctataacaccaaatgaaaagcctttagactatattatcatagaagctagtccttatttaacaccagattttattggatatgtaattttatatacatattgtattacatacctctacctaaatacagaaatactttacagccttattatgtgtaataaaaaaatctaacatcttctcaagccacattgcagatggtagtattatctggatggtgcctcatgaacaaacttcaaaaggaaatgttgatgtgagaagattcctatggttctggtaagactctacatccccctccccccaggtctgtggaataatgtataggcatataaacagtacatacatggcatcaattgttataaccatatatatgtgtgtgcgtgtttaaattgtattaataagatttttttatacactcagcacctaacagtgtctaacacattttatatcttccaataaatgaatgaagcaaatgaaaacatcagtaaacagaaaaaaacaggcattttattcagtttactttaatttgagtggtgtttggttgtaatatctgacaaaagttagtgctatttaatggtttaaaataatttaatgtgtagttttcccctttaagttttgccctgtatcttttgctatggtctgtcagctataatttgttcaatcttttgtgtagctttcttcccagtcttacaagtctaattggggaaagtaagggaattaacaatgatcaaaagtctattctttttctaaacattcacatatctttgaatctctacaggaatcctggaaaagaggatcattttgcagaaaaaaaacataggctagagtttctgaacaccttgtcccaaaggtacagccagagtttgaatccaagtcagtctaattccaaacatagatcttttcctcaaaccataacattttcaagaactgtattttatcatttcttatgatccctgccaacttactcacaatattatcagtagcctagacattcactaaatgccaactgtgaacaagtgaagcctttaagacttggatggtgttgaagttccctggtgtgatatttcagtttactcagtacccacctgaatgaatgctttgaagaaaataaacaagtgaagcttaatcagctaagtaaatgtttggataaaaaaatgaagcttgtttaaataagggaaagcccttattcttctctgatctactcatttaagtcaaacaattaccataaagctaattctcaaaattatgttttctttaattattgaattgggttagtactgtcctttgacccattagtccaaatacacacatgcacagctacacaaatatatatatatatataaatatatatatatatatatgtatgtatacatagagagaatctaaaaaatactctaactgacaagatggagatgacactaatttatgcatatatcagggcaatttcaatttctgcattttaatagcttatctctgatatttgcaaactaagagcttcatttacagactgtacttgtatcatgagttcccaaactacaactacaaatgtttaaatatctttttaaactgagtgtgcatgaatgttttttatcagaagcattatttaaaataattactattatcttttaagtagcatcaggctgttggaatttgctaggaactaccaacaaataccttctcttaaagatactgatcagggaactccaaacattcttgcttctgtatcccctaaaaagactcttgaaaaatgagtcaacccttgcagatttaaaatccgcattcgaaatgtacttttcattcttaaatgactgaaaataatataatttgagggacattgtaaatatcgatatcttaaaactaagatatatgtttatgcctgaaaaaatcttattgatcacctagtatacttttcttaaacagtatgtatacacaatgagtgttttttttctgttactgtaagtcctaaatgtaaaaaacaaaccttttcaattgaggtattgttacaattattaacgtgcaattgaccaaaacaatatatgtatattataaaatttgataaacataaaaataaaattttattgaaaatacatctcttaataagatggatgggtatttaacaatttatacaccttcagaagaatataaattaattctacaattggaaaggcttcagcatcaattctatccctaatttttgtctgtatagatgtaaatgatgaaaaatcttattcaaataggtgagtagaaagaaacggaaggaattgtattatagtagcattgcttaatcatttgtgctcctgctatggcatatgctaaaagtacatgatgattgcttaccaaaacgtatttttaatgatctatcggctgacaacttatcaggtcttctcttcgggttcagttgaaagcaaagagttagcaaccactcttcttgcaaaaagctatgttgccctgtcatgaaagtcattcatgcttcttttgtttgaagccttagtaagatcagagttggatgaaatataaggctttttttcttaaattgggagaagtggttagaaaaggcaagtggttagaaaggagaaacagcctgaggtcttgactacagatgtcttttttttttttttttttttttcaggcaattcagttttcaggaagagtacaaaataaagtagaagatctagaaataaattcccttaaaactatctgtgcctactccttggaatgccttcatgtactcccaggttactccactgtgaggacagctgttttaagaaatttcgaatcattacctgtgacaagaaatataaactggcacatcagaatctcctgataacttgtgtgtccacttcctcagttgtacctcacagctaaatagttatctgttaaaccaagagaagttgcagttctgggggcaatagccttattggtatttgtgcctgaatataattctgaactccctcttttctaccttctaggctttgagttcatttatttcagcagcaaaagatgtcaggagcaagaggcagtcccacatagtgtagattcattgaatgagggagccaaacagtgatttagaaacaacattgccagtaactatctgattagccttaggcaagtttctcaaccttcctgaatctgtttcttcacaataactcccagtctggctgcaccttcgactcacacaaagatctttaaagagatactgttgtccaagcatcgcccccaggaatatggatttgattctctgcttaattctaaagtgaaggcaaaacaggaaaagtcaaagttagaatcattatccatatagtctttcaaaaaatatataataagtgcctatcatgagcagtgttgcaagttttctgtgttaaaatatctacaaattatacttctaaagaaaaattgaatgctacttgaatacaataaatgatacatttgagcttatcagtcttgaaaatcctttgttcaaaaacgatgcaaagtagagagggcaatttagtctacaaaaacttttatttaaaaaaactgaataaatagcacagacacatccaaaaagtgtatagcatggaaaaattcaataatgtatagcacagagacacccccaaatttgtgttgtttatcatgttgcatcatggtcttaattccacatttcatgtagcagaatgtatcccttcattttgagatccagaaggacaaaagggttgcacagttcccctttttctgcctctcggagatcttaaaaatgaatgataaacaattaattctacccaggataccaatgaaaatctattttcttttctttttcccaaacaaaaacctcagaaggcaagtaaactgaccttttaaatgaacaagatctgacatgattgagctaacccaagaaagaaaattcccctctgaagtgaataattttttaattaaaaggtgaaatctgacacatcacactggttttgttattattgttgttttcttccattaatctcacactcgtaagaaaaaaaatgagtgtattatatatgactgtgttttatagatgcatatattctactctatccatttcagtccatcttttcttaatgcatttgtcctgtcacttttactcactgtaattcaattttgttaggaaatgtaactcgctgttttatgctttatatatttcacctgatgcaaaatggactacctgattgattctgcatttttagtccacctttgaatttatagataaagatcaacaattaactttaagcattatgctaaaaaaatcttagccagaaggattgcttcctgaaaatgatttaatttgtatttttcttaaatataataaaatgccctgataagaagtaatcaacaattttgattctagttttccatttgatttgaacatgtacattatttcagcatggtggatgatacatatctacagcttgaaatatgtgcattggggaggttttgttgaatgctagattgctgttttgctgtagtttgatttatttgtgtgagttattagcttgatattggaaagtaactaaaatttgaatatatgatatctctgcttctgaaataaatatagcgattgaaaatggaccttttatgaacgttgagtggggcaatttctggcaggtggggaagagagtaaagaagattcattgtatgaaagcaaagcaaatacacatagaacttgtaatttaacggaacatatcagcagatgtggttctcagaatgactcttacatttacattaatgactatctaaaaagaattagacagcaccgtgaacttcctttttcaaaattaaaagttttttttaaaataaagaagttcagattttagcatcaactgaccaaagcataaggggccatccaagaaaaaaaataatctgaagcactttcataaaacgatgttacaaatcaatattttagacactttgaagatcatctccttgcttttcaaccttcacacttccgagacaggggatatatatgtttatatcatctctttttctaaaataaatcatttctgattgagcatcttttacagaagagcccactgcaaatgtcaatttttataattgcccagaccatacttgtgggaaaaatgaagggacaagagtaggaaggtcattcagggtcactgaatacatttctaccacaggaaagcattacgtcttttgcactttatttcttcaagccattcccttccaacatctcatatccctgtccccccagaaagttggagtcacaggtgacacagctgggaaaactttctttatgaaaagattaacacatgttttaaaaagagatacatatgtatgtcaaaattattccagaacactgttctcagaagggcagtaactgcaaccaagttagtttctgctattgaaacaaaatgtgaagctcatggggaaatttcatcacaatatgctgtctatgaattaaaaatccatttaatataaagcctccaagaaacaaagaaaacttgttttttatttttacagaagacaacgtacaactttttaacccctaacctaattttttaaaccaaaaccagaattattttttttttctttttagctttcaatgaagcacaatcaaattcctggagaaaagatgggaaaacggcataaaacaaagcacgaacacggtatttaaatccaagtttgccacaaaatgtaaatgtatttcagtaaatgttctataggatttgtaaacaattgaaaagctgttatttcttttacaactgcaacataataaacattataataatatacctttctggtaatgatatagaattttttatctggtgacaaatagttctgccaaaagacagataaagtaaatcaaatgcaggcgtaacatctatattatgtagatgtgtgtagttattactagtggagattaatatgatttattatgcttataggtcatttgtttgacctttatagtaaaatgccatttcatatccttcttacatattgttattattaacctccattagtcatatatttttgtaaataccttctctaaatccattatatattttaaaacttggtttatgatttattttgctctatggaagctttaaactatcagttaattcagtctgccaattttatgttttaagtcttccaggcttcctgacttaccaaaaatctgtctcccatgaagcttataaagtcctacactttcctttattgtttatatgaatttatatttctagttagctccttaatctagtagggcgtttttttggtctatagttaaacttataggtacatgaatagtcaattacgagacactatttattaagtgaaataggctatccacacagaactaaaatatccaatcttatttggatgttttcctggactctcacttgtaaaccactaacccatttctctagccttatgccagcacactgtggttttgatcacaattacttcaaagtatagtagaaatctggaagtgtatgttgctgccataatatgcttattaataaaattgtttccaatttatacacacacatacacgcacacaatttccttctatataaactttaaattacatcattgcctatttcctttgaaattatattgcccccaaacacatcaaaagcattctgattataactgtattaaattcaaatgttaacttggctggtattgcaagtttaatgacaataaatcttaaatcctaaaacaatcctacgtagtcaatttttgctttttcttatgtatatttttatgcttttcacctatagggtctacaatttttattcctccttaatttatacattgtcatcagtgtgaatgaaatatttccatttgcatttatagtcattaatatgaataaaagctattatgtatctattcataaagtatttttaaaattatttcacagattttaaaattgagtctcctaggttttctctgcacaataatcctatttaacaataatttttcttctttaaaaatatttcttctttccttttgaggttatcattactattattattttagaggtggaggtcttgctacttttgacttatttcatgagctagaccaagcaaagcaaatttgaaaactttgaaaaataaaaatttgataatttttaacgttgacaatggtgcttctttactagggtgtcagcaaactacaaaaaaaaaaaaaacaactttgttttgcaaactttgtatttataaaattttattgaaagcacaggcacacctactaatttaagtattgtccatagctgcttccaatgccacaactgcagaatcaagtaaatgtgacagagactatttgggccacaaaacttaaaatatttactatctgccccattacagaagaaaaaatgcagatttctctttatccttctccttccttttactacgcagcaggcatacttctaggatttttttttttttcctatataaccacatattatttccgcaaagttattaggaagtacatgggactttccagccccatttcacattggataaaactgaggcatgaataagctaagtcacctgccaaaggtcacgtgggtggcaaatatcttcagcaaaattttgaccccaaaagcctaactatgagttcataactgtgcagtagaaccctttcatctttggtcccatagcacttatcatactgtattgttttgttacattttttttattatactttaagttctagggtacatgtgcacaacatgcaggcttgttacatatgtatacatgtgtaatagactgtagctatatgtaaacataccagctttcttagatgttacttcctcataaagacctccccctagaccagtgattttcaactagggatgattttgctccccaagggacatttggaaatgtctgggacaaatttgtgattaaagaagagagtactattggcatctaatgggcagaggtcagttgtgatgccaaacatcctatagtggacagggcagtccaccacaacaaagatgtatttggctcaaaacgtcagagattgagaaacattgccgtagatcaattgtcatcttctgaactttgacgtttacacatgcaactaattgtacaattatttaacatctgtacacccattcactgctttcaccactagactgaaaaactccatcagagaccacatatgttttgtgcaatgctataccgcctgtgccttccgcaataagtgacacagcagacactcattaagtataagcttagtgagtgaatagtggataacttaaagttttatagtgtatacatgggacttgtcaagagtctctgtgtttcataaacattgtcgtcatattctagctaaccatatttaaaattttatatatatatatatatatatatatatatatatatttcaccacaagatttttatggtggtgcttttatccacagttataagttctttaagagatattttctatcattaaaaaataaatttatgcctatttactgaagtatttgtgaaaaaagcccaactgacgagtaggttagaacattcgaaatcttcaggttttgatagttttgttttacatccgtgttaaagatgttttaactggctcttcaacattctctaagtaggtagggctggctctaggcaagcacctgaagtatagagttagcttcaggtctgccttccttttcttacctttaggatttcctggtatctttatcctatttctcccaatcccatcttctgctctgtacctctcttgttgggaaataagactcagaatcacagactcttagaacacaacaggactttaaggccacctctcctaatcacccaactgataaacaaattcccatgtataactcccaggtcccaatttttcattatcttgcctatgatcaggtatcataagtgctagaaaacacactattaattgaggcaccagttcctgcttttgaaagttctgatatttagatggctttttgttgagtcaaatgtcaccccccactttagcttctatcgagagactgtgtacctcttggaattattcagcacaagtttaaatttttgtgtccgtaacagtccttcaaacatttgaagacaactatcatctctcttcttctccctgctaaacttccctagatctttcattacctagatgacacagcgtcgaggcttctcaatgtatgaacaactaactaacttccaacttttctctgactggtttaaaatctcttgtaagatttgactgtttattcattacatgaaggaacagcgagaataaggggataatggttccctctgttctctcctcaatgcatatttgttgtatactctttgccaggagctatgctaggtcccgggaacacgattttgggcaaaatagacagattcctttccctcttgctgcttataatacaattgtccctcagtatccatgggggattggttccaggatccccacggatagcaaatccacaaatgttcaagtgacatataaaatgacatactatttccatacaacctacacacatcctcctatatactttaaaacatctctagattacttataatacttaatacaatgtaaatgctatataaatacttattacattgtactgtttagggaataatgacaagaaaaacacctataaatcatcagtacagaggtaggcattcattgtttttctgaatatttttgatgcatggttgcattcacagatttgtaatccaagaatatgaagagcccctgtaccaggtaagagggacattgatggaaacattacagttaaaactgaggttacaaatacgacaagtgttgcctgaaactatgagagcatataataagggggcctatatttaaaagtaacatctcacataatcctcacaatgacccaaacatgcattttcaccttaaatatcaggaagcaaaattgcacaggtattcttaacatggatgccgggtctgggcctcaagaagaatccctggttccttcactctatgagggaggtatgatacccaagactcaaagccaagtatgcatagtcttaactcatagttccttctgacaccatgctttctaccacaggctaggattcaaagtcagccataaagatccagaaatgagtaaaacatacatctagttaaggggagaaggcttaattgctctctaggttgccaatatgaaatgaaaaagaatggctaaccacatctctcagcattgtcaaaatagccaatgaacagagagagcactgcaaagacccccaactcaattcagacttcatttctacctatgtggaattgctgcagccagaaatttaagtaaatgttacttaaatgtaagagccatgtacctaactcttaagtggatatcctcaaatgcaaatatccatttaaaatatacaagaattactgtgatataaagtaacaattgctatgtatcttttacttttgtcgcccagtggcctttagactctggatatatgttaactggcatggctactttggaatatttactcatatatgtaaaccataatggccttaaggactacagataaggcttctttcatattaatcaactatctttcaaaatgtgtaccgcaggctgttctcggaatggagctagatttcagccattagcaaaggtctacaaagtaaaatcactgttactgttaacttttatttttctgattaaacatggatatcatttggatatgtgtccccgcccaaatctcatcttgaaatgtaattcccagtgttggaggtggggcctggtgggaggtgactggatcatgtgtgtggatttctcatgaatggtttaacaccatcctcttggtgccatcctcatgatgatgagtgagttctctgagatctggctgtttacacgtgtgtggtacttcattctgtctctcttgctcctgctctagccaggtgaagtgcctgctcccgttctgccttctgccacgactggaagcttcccgaagcctccacagaaggagatgctgctatgcttccggtacagcctgcagaactgtgagccaagtaagtgtcttttctcatccattacccagtctcaggtatttctttatagcaatgcaagaaaagattaatataacacaacacacagacacatgaataaactcataatacactaattaaaacaatattttgaacattaagaaaacatgcccatgtaattttatgaatgtctttcgtatatcctttcagggattggacgttcattctaacatacctcttatatattgtgcattaatttaaaaaataaaggctttatggcttcacctctgcctgtgtattgatggtgcttttagtgtttcacctttgctgttctgctaacatatcctcaataaatcgatcccaagtgccagaaagcaaataaccctttattttttgcacatttagaatgtttcccccaaaaaggagggagacggtaggtattagagagtgcctactgcgtggtgttcaatcacaataggcccttcgattaatatttattcattttgacatcccaacttgttctagtctgtgatggggtctttaacctggcatctgtggatgggattaagggaggtcccaggatcgcaggaattatattacataaggtaaatacctttgcgttgtgagtcaggtgttacattccatttcacagtggaagattattgagatccagcaacatacccacatcattgataattggtagacatggggttgtataccagctctgtgttactctaaaacacatgcttgcttcaacatgccacactgccttcttacagagctgtgaagaagttgaaatcgcgaaagctattaaagatcaaggcagataaacttcatattatgcagccttcttgtgagtataactttcaattatctccaataaccttaactacatacaaaactatcatacatcaatgatggatacagaattaatctcatttgaatcaaatctttaaaagaatttcaactgttgatataattttgaaaacaaacttttttcagttgaggcataatttgcatataataaagtgcaaaagtctaagtgtttggatggatgtgttttgacaattgaatgtatctatgtattcaccacctgaacaaaatagacaacatttccattaccccgaaaaagtcactaatgcctctgtccactcaattccaaccctcacccagaggtaaccactttcttaattctattaccgtaattgagttttgctgtgctttaacttcatgtaaatacccatatttgtgtctatgacttttggctcagcataatatttttgacattcattcattcatatggttgcttttaccattggtttttcctctattcactgccgagtaaaattccattcatggtttaacagaggcatcaactttttgtgaggtagtgagggaaggaggagggaatgactgcatttcatgtgatacgtaaatggaaagaagcacctagctacacaaagagaaaaggaagagcattctgggtctaagaacagagaaacacgtgcaaaggccctgagatgttttagaaagtgaggaagcactaatatgattatcctatatggattgagaaaggttgacttaagaagaaaatggtaaagatagaaatataatatattcattatgtgttgtaattcattgtattctaagccataataaagagttgggtgttcatcctaataagataaatccatgagggccttaagcacagaaatgcctttatctagctgacattttgagaagatccattttgctgcggtgtaggattgaataggaagagaataacaacagtagtaagagaatgtgacctaatctggcaagagggcagaggtgacctggcctaagatgggggagatgcagaggaagagaaggcaaattcaaaataaatttttggagacagaagttgcattgcattacttgcttatagattagatataaaatgggagataaatgatggaatcatgtggactctgcttaccaatcaagtagataagaagaagatactactgtgaaatagatgagggctggggaaggggaaagattttaaataaaatgtcaaagctgcatgtgcggcagccaatgaattgtgtcatatgctcaggtgaacaagcaggtttggaatcaagagaaatatgggatggaaagatagaggagttattcaactaaagatggcagttaagtccgtagaaatggatgctatcacctaggaggagagcgaaaccagaaaccctaggattgaaggtatagtctcaaactgtgacatacctacctccgaggaatttggaacaactcactgggacacaaaagaaaactgtgaatgcttctatttgtgtttgcatttatatttattgatttctattttcacatacgtttacatgcttagtcatattcatatatgatttacaaataaatgtacattttgtgggaagaaatgtgcttataagttttgtttcaattagaaagcagtcttgaaattttgaagagcattgccttagaggtcaagaggcggaggaggagctagcagaaacagctgaaaagaagccagtgagcttcaacagaagttattgtttcaagaagaaagggagtattctgttgttccctctttctatctgtgcagttgtgggaaatgtgaactcatagtttgtctcgtgtggtcctgttccaaatgccatacttgctggaaatagagtgcagagcatccataaaacagtctataagactaagcatatataaggctgccaaagaagtcatttgttactatctatcttcccattcattttctcaagtctagttcttctgctggcctgtggttagggggtttattctgagtatttccctgtgtctttaaaacttcacatttatatttgatggtattccatgaaatcatcaggttacttgtcaggtttcaaatattacatgaactattttggaaaaaaatgtacatttcaggctcatttccagtcctaaacaatataaattatagccaagtatggcatttagccattaatgctgtctttcacttcagtaatgtaaagaaataataggcttatgacaacttggataatacatttaagcttctacattattgctccagatataaaaaaaatttttcacttcacagaggttctaccttgaagaaagaaaaccaggctccagatataagcctgaaactttcctgagtttctgacttttgccagccatttcatcacactaacaacataaaccttaaatagttaaaacaaatgtaaggcatttatgttatatattcaaatggatataccatggaaaaaaagaacctattactgaatatttagtttgcttcaggcttcgcaatcattatagattccacatttaatatatatatgtgctgattgagttgtcttcattatttcttataaaatatctccaatgttcaatctattgatcatgttgaaagaaaaagggtttagatgagctgtacacatacatatatactctcgggatcatgataaaacaagacaggtggcctggcacggtggctcacgcctgtaatcccagcactttgggaggccaaggtgggcagatcacgaggtcaggagatcgagaccatcctggctaacacggtgaaaccccgtctctactaaaaatacaaaaaaattagcggggcgtggtagccagcgcctgtagtaccagctactcgggaggctgaggcaggagaatggcgtaaacccgggaggcagagcttgcagtgagccaagatcgcgccactgtactccagcctggggtgacagagcgagactccatctcaaaaaaaaaaaaaaaaaaacaaaaacaaaagaaaaaacaagacaggtgactttgaattttaatgaacaagttagaaccctcccccaacatctggttttaaatgctattactttcggtatgtattgcttatcttaataagtatgatgagcttaaatattagcttatcttcgggtccctctcttttttattttaatttttgtgggtacatcgtaggagtatatatttgtagggtacatgagatgttttgacacaggcaggcaatgggtaataatcacatcatggagaacggggtatccatcccttcaagcatttctcctttgtgttacaaacaatccaatcacactcctttagttatttttaaatgtacaagtaactcattattaaccataatcatcccgttgtttgatcagatcaaatagtgtgtcttattttccctgtagaattatttggaaattttctgtttatgttttcatgagctttgggatttggggaagaatttcagcatttttgacttaagatatagttggttcacttagcccagcagtgaacttcagggggtcaatagcatgcaaatatgtatttaaatattaaacatttttgtttctgttaacatcaaaaatttattggacatttaatcttttaacagaaaatatctcatggtttcatatgaaaagtggatgttcttcacattttatttatttcaaataatttacatttatttttacttattggaattggaaaatataagttgtatatatcacgtattatacaacacattgtattgaaaaatgtggactagctaaaatgagctaattaacatatgcattacctcacatactatttttttgcggtgagaacacttaaaatcgactctcttagtaattttcgaaaacatattattattaattatagtcactatgtcgtacaaaagatctcatgaacttatgtctcctatctaactgaaattttgtatcctctgaccaacacagcccttttgtatcctttgattttaaaaaaggcgttgtttaattttaacagtgtcaagacttttaatgataccaggtcctgaaaatgtcagactgtgtttcccatacagtttctttagcatgaaaggggatgtatgcatttgaaatatagtagttgatgaacatcttttagatttttcagtagaattaaaactggatgataaaaattcagcacatatcaactatattccaaaaatcaataaaagtgcctaggagaaacatttaaaaggttaaggaaattaagaaaatggataagataataagataatttaagaaaaattatccaaaacttagaagtaaaacaaaagatgatcgtgtgtgtttcaaaataatggtagcgttgttttctaacaaactcctcacaccctcacaagagcttcaatattttcagagtaaagcaactcttactgtttactattaatttgggcccacacatgttacaacgctatgaagttcaatgcaaattttagaaaactgatatgatgtaaatgactttttacccagtagaggatataaccccaaaggctgtagggtatcaacgagtttagtatcttattcactaatcttattccagaatacttttttaaaaattcactcattatagaagcatttgtttcttgtattctcttttgaaccagttttgtcttcctaccagctctccaattactgtattaaataaaacctaccgtgagttcactatgatttacatgaaaattatgtttcttcataaaatttcactgtgctgataggtggtagaattatgaattttctttgtacttttctccattattcaaaatgtccccagtatactctgaacaaaattaaacatttaattggaaaaaatacatgctatatgcaaatctatttagcttcgtgttgccttaggtatgcaagacgttacatatcatacaaaaaaaatctaagccaccaaagataaaacagttttgcaatcaatagtgtttttccttttctcttccatcagcagcacagcgatgtacaataaggaaataaagtaaactttagaaatatgaaatgtgtatacgtattgacgtgcttattgtgaatgcgatgagaaaggcaagtcaggacagtgagagtcaggttcattacactgcattctcacactataaatgaaagagtagcaagtattggctaaaattcaataacttccatggccaagatacctactataatttgaacattgattccctttgagaagctttctcctgaggcaccatcaagacagatattaataattagtagttcagctaggggttggaccacaaatatcaacctgaacaaactacagaacaccctccacatttgcttcagcactgacagttttgaacactccctggtggccaaactcacttgttttcacctttgaaatgagttagttttcactgagtgctgttgggtactgagccactagcagaagtgaggatgtgcagtctgatgactcacggttgcacgccactaaatactgccaattacacacatttttccccttgcaaattttggggaagggggaggggtgtgaagggggaggggtgtgaaggaggaggggtgtgagcagctgcatataaggagtgcctatactttctttcttttcttttttttttgagacagtcttactctgtcacccaggtcggagtgcagtggtgctatctcagctcactgcaacctctgtctcccaggttcaagcaatcttcccgcctcagcctcctgagtagctgggactatcagcaagcgccaccacgcaaggcttttgtgtgtgtgtgtgtgtgtgtgtgtgtgtgtgtgtgtgtgtgtgtgtatttttagtagaggtggagtttcaccctgtaggccaggctagactcaaacttctgggctcaagcaatactctcgccccagcttcccaaagtgctgggattacaggcttgaaccaccatgcttggccaggagcacctatagtttctacctcaaaaacatagccccctatacctttccacagattatattgttacttttgatattgaacttcttttcattgtaaaagcctggagaaaatttaaggctgtttatatatctgttttctaaatcagcacaccaactgtgaactctgcacttttgaattgggatgagagaatggaaagaaaaaaggttgggagaggagcggagctgggaagaaaggtgatctctagtcctttttcctccgctccctgctccagctcacttttccaatcagtttttataataagcattatttattctcctacaaaagtctcaaagtttactagttataaaaaactcatgatgctttattaaatagggtaaatttgactttgtaaagcaaaaataacaaaatacgtaatttgtaattttcaaaatatacacatgtaatttgaaattacatgtaatttcatattatgcatgtgtgtaatgcaagcacacatgtaacaatacatatgtaacgtgttatatatgtaacacgttacatatgtgttgcatacatatgcacgtgttaggtaacgtgttttacatgtcacatgtaacaatcaatttcacatgtaacatcagttacatatgtgaaaacacacatatgtaatcacacacatatataatttgaaatttttcatagccacatttttaaaagcaaaatgaagtcaatttaattatatattttatttaatcaactataataaaaccataattttaacatgcaataaatgagcatttacttcctttttggttctaagtattcaaaccctggcatgtgtgttatactcagtgcccatctcaattagtactagccgcattttaagagctcagtatcttatgtggctagggggcactgaattggactttgcagctctaaagagagacctcacattgtgatttttattgtcaggcaaatttcaaaattatttctctgcttggatgaggcaccacgtctcactccttgcaaatacatcactctcactaccaaatcctggattagttcagtgttgatgtcatattgttatgagctcacaacacctgtagcattcacacaaataggatacagtggtttaccccttatctgtaggggatacattccaagactcccagtggatgtctgaaactgcagatagtactgagccctatataaactatatgtacttgtgataaattttaatttataaatttggcgcagttaagagattaaaaatcatgaataaaaatagaacaattataacaatacattgtaatgaaaatcatgtgaatgtgatctttctttctctctcttaaaatatcttattgtattgtagtcacctattttcagacagcagttgaccatgggtcactgaaactggggaaagcaaaactgtggatattttgttccaccactgtggagatgtacattatgactacatcattaccaccatctgtggttttcctttaagggtgagactatttatatgcaaattcaaacaccccccccccccccaacaaggaggccatatttagattacctcctggaaagttacttaactctctggaatttgaatttaaataaagagtagacttcttatttcattttgggttttgagaactatatcaagagctcaatatcctgtgaatgaaatactgatcatgcaaacacagccaaagattgtctagggaaaatgctgaagggaactttccaaatccactatagttcttctttcttaccattccatttatgggctgtccacttactccctggcatctgtcctgtgcccctttctgattgtaagtacagtcaacaatgatacaggcaaagtcattcgcttatctgtttctttaagactccagtgcaatgatacaattagacttccaaattctcataagtcaaaaggtacaaatccctgaaaactgctgaatgagtattgaagtgttggcagttacagcttatgatagaatttttattttcaaaagagaaatttaattcagggatatcactatacgtatatccttttatttcctttttgggaactctataagaagccatacttgtttcattgctggatctcttatttcctggaataatacttgtcacacagtaggtcaacaaatatttggttaatttatgtattgagagaattgcttggcacaattcaaccctctcaaagtttatgcaggtgagcaccgtgcagtatagtctcctttggcagcaagagcttaatatctgattttgagagagctgagaatgatacgcaaaacagcattagtttcttccctatatttttaattacagtaatgctgtcttttaaaataagactcctgagtactttatgatcataataaatccatcttaatcgcattcactgctttattttcttttttatttcttttgagacagagtctcactctgtcgccaggctggagtgcagtggcacgatcttggctcactgcgacctccgcctctcgggttcaagcgatactcctgcctcagcctcccaagtagctgggactctaggcatgcaccaccacgcctggctaattttcatatttttagtagagatggggtttcgccatgttggccaggatggtctcgatttcttgacctagtgatctgcctgcctcggcctcccaaagtgctgggattacaggcgtgagccaccgcacccagcccactgctttattttcaagcagaaaacatacacaacaccttcagatggatgctaaagtagaaataaactgtttaaaaatgattgtcatgtggtatgtctgagaagaaaataagcatcacaggatcacaaaatctgttaaatatctgtctccaatcatgacttgaagttgcactctttcaagtatgctaaactgcagttttcctttaaagttcaaaccgtaattataatgtaaaaacccaggaagtatacagcaaaccgtaagtatcctaaacaaacttaaatcttgaaaagtgcaaatctcatccccaaaagcctttgctcaaacacattctgcaactgtggtttataggctaaaacacagacttgtctgtgtaccgtgtaatgtcctttgcaaagttttcctaacctacctgtctggcccatgctatcaccctccatctggaggcctgggatcccaaagcttttgccacttaatattggttgccattctccaagctggcttttccagactgaggtcatctcttctgtttctataaaacttttaaaatacagttattatggaaatttaaaactattatgctatatcataactttgaggtttatgtatctatctctccctgcactagactggctttcttgagtgctggaaatatgattgattccttattccctcacataaaggcaggcatctgcctccctgactgaggtagggtcactgcacaagtagtattgttttcctcaatgttgaaacttttggtctgcagcactgtcctgaaacttaagaaaactatgttgaatgagccaaagaaggctgatattcagggaacagtaaattttaaggaaaagcagttttgcctgtagggaaccatgtcttatggtgggcttttctcttgagggtattctgaaagggaggcaattactaaatccttggctatgatcttcaaagggcttctgccctgtggaaaccaagaggctttcttagagaccatcagcccttgccatacacaatccaatgctcatgtcctccatttgacagccgcttgctaaattcctccgtcacctcagtaacctatgtcttagagtgatatagaatccgccaaatctatatatcaaacagagattaccatgagagtaacaatgtaattgaaggcacttcttaaattatgaagtgctttgttatgttatgactactgttattatcatcaacaaccctaacatcatctctaataacaactccttttaacatccttcttttaatacactatgggtcaaattataattatattaataaatatgttatgtctcaactttactgatgacaatataaaataagtttaattagagctctactcataactaaataacatttttatgaataaaagaagtttcatcttcatcacttaatatatttaaggtctcttaggaagaccttgtcctgtagtcagtggtattattctttttattagtttcctcaagatttattaggcagagcagtgacttaatgtttttggcttaacatttctaacttctagctgatgaacagtaaaaaaaatatggtgtttgaatcccagattcttcatttattagctttatgatttgggataaagcgtttaaactttccgaaatttttgtctaagagttataagaataccttttctacctatcttgctgggagtatttcaaaatcacatgaagtcatattcttggtaatttttaaaacagcatgcaaaagcaaggcactaaaccaactttataaattactgcaatgaaataaatcttgtattacatctttctgtgtatattcttgtaaagttgattttgtactattttccaaaagtattagttttctgaactggcttcttaattttctaaaacttatacttccttacactcaccatattacaaccttgtgacactcaaccagaaatcacccaacacacacatacacatacaactgtgttagtcccttcttgcattgctataaagaaatacctgaaactgggtgctttaaaaagaaaaggggttttcttttgacttacggttctgcaggctgtacaggaagcatgtcactggcatctacttctggtgagagcctcaggaagtttacaaccaaccatggtggaaggcaaaggggagagcaggaaacaggtgggggttgaggtctcatactcttttaaacaaccacatatagcatgaactaacttgtcaccaaagggatcattcatgaaggatccacccacatgatccaatcacacctaccaggccctgcctccaacattggaaatcacatttcaatataagattcggaggtgataaacatccaagccatctctctctctctctctctctctctctctcacatacacacacacacacacacacacacacacacacccacacacacacagtcgcaattaaaacaaaaaatctgtgaaacatctatttgtgatgaatgctgatattttctattttgtttcactaaaaatcaaaggccggtgttgatccacaaactgagtttatgattcacagtttggacaatgaacactagcatactagatttaaaaaatgaaattaaccaaaacaaaaccaacaataaaataaaaaatgtcctcagcattattttgtgccatttctttccatgcatccaacacgcttaccaagagttcctctcatcttgtcattatcataccacaagtttttctgacaccatcacttttcaactttttctcattttcatggatttacaattctctcccttattttcatatcgctctctctatgaagctttcccaattcttctggctagttactctttgggttgcctctgctctgactcatcaatggtgtaccgacctctattatatctattagatgctatttttatggcttaaatgtccatttgctaattataccacttaaatgtttcaattgtttaaatgtccatcaatttcagcaaaccttggattatatgtgaataggttaggattgtatcaatttcaatatcctgagcacctagcatagagcctgacacagagcagctccaaaagtaaaagttttctgaataaatgtgttgatgttaaaggttaggtgaaatgtagagaagtgtcaaagtacacaagatgttcaggttttctaagataaaggtaatctccctggtgtgattctgtcctgcacagctgttctcttgagcagtggtcctttatcatcatctgccttctctcccacctaagtgcgtcctgccacctgatggacgatgatggacatgagtcctctgaggccccaaaactatctttttggttgtgaactaaaggccgacaaagatgatcactttaaggtggataataatgaaattgagcaacagttatctttaagaacggtcagtttaggggctggggcaaaggataaattgcacattgttgaagcagaggcaatgagttacaaaggcagtccaattaaagtaacactggcagctttgaaaatgtctgtacagcccatggtttcccttgagggctttgaaataacaccatcagtggtcttacggttgaagtgtggttcagggccagtgcatgtgagtggacagcatttagtagctggggaggaagatacagagtcagaagacgaacaggaggaggatgtgaaactcataagtatatctggaaagcgatctgctcctggaggtggtagcaaggttccacagaaaaaagtaaaacttgctgctgatgaagatgatgattttgatgatgatgatgattttgatgatgaggaaactgaagaaaaagcgccagtgaagaaatctatatgagatactccagccaaaaatgcacaaaagtcaaatcggaatggaaaagactcaaaaccgtcaacaccaagatcaaaaggacaagaatccttcaaaacaaggaaaaactcctaaaacacccaaaggacctagttctgtagaagacattaaagcaaaaatgcaagcaagtatagaaaaaggtggttctcttcctaaagtggaagccaagttcatgaattatgtgaagaattgcttccagatgactgaccagaggctattcaagatctctggcagtggaggaagtctctctaagaaaatagtttaaacaatttgttaaaaattttccatctgatttcgtttctgtaacagttgatatctggctgtcgttttgataatgcagagtgagaaccttccctaccatgtttgataaatgttgtccagattccattgccaagaatgtgttgtccaaaatgcctgtttagtttttaaagatggaactccaccctttgcttggttttaaggatgtatggaatgttatgctaggacatagtagtagcagtggtcagacatggaaatggtgggtagacaaaagtatacatgtaaaataaaagtattttaataaagtaaaaaaaatgataaaggtaatcacattagaagattcatctcttgggtgcaacagctagggtagcctcccaagccctgtgtggtagtagtcagtatcactactatggtttcaatgtttttccctccaaaactgatgttgaaatttaattgccattgtgacagtattaaggggtgggagctttaggaggtgattaaggattgagggctccaccctcacgagtgggtttggttcccttataaaagtgggagttcagcccccttttgatctttcttgccctctaatcgtccatcatgtgatgacatatcaagtaggccctcgccagaggctgacaccttaatgttagacttcctagtctccagaactgtgagccaatacatttttgttcattacaaattattacctagtcttaggtactttgttacagcagcacaaaacgtattaagagagttacctacttatcttttctgaacatcattacaattccatttcaaaatttctgctcttaatgatatcccaaggagactagaaaatatttcaacagttcagccactcttcaatgaaattatcttgcgtggtcatgtactcgttaaattgccctgaccattctttgaaggatagcactggttatgagattaaatttgaaagttcctatgaactatcagttgagtgaatttgcttattatagcatatatcttaatcatatgttcataagcctccattaagccaggctgcacagtttatttttttaacaattgcattgttttaaagttacagttgtttcagcaatccattactagtatttaaaagtacacacattgtccttttgtaaatacatacaacagccataaattataaaaaaatagaaattcaaggataaaatgtttgaaaaatgtgttatttaagattagcagtaaaattggattttcaaataaatccatgttaactaggatttacaatacaagcctgtactatgagttgtaaagccaggattttgagaactatgctgccacattaaatttattcattttcacagcctgcagacattttaatgcctgagtagcaataagaacaaattaccaaaaaaacttttaatagggtataataaattaagactgaatggtaatgcaaacgtgggtacaacaggacaaaattatgaatctcatataatgacccaacaacacttagagtgtggaaacaacgttggtattctgggatatacgaccacggttaatcctaattgtttttcccttgtcaaatagaaattgcacatcaatctcaaagtattacaaactgttcattacatgcaaatggttatgttctgcaggctctccaaggggactcaaccttctttacaaaaggagccaggctagaagcagagtttctctaatgacagtaagtatccattagagttcctcatatataagcaagagagactgcctctgattcccaaagtcaggttttcccaagtcagactaggtatcccagaggtgtaatggaggactgtcaattagggggcaggaaaaataacagctggaaaaacaacccaccatttgtcctaggccagatccagtactttctggagtgtttacttactgccctttgctttagacgttgtgccttaagacgttgaactcatgagactgtgagctcataaagagaaaaggagctcttagtcagctctgtattcctagcagcaagcagtatctgctttgcacacagtaggatcacaatatatgtttgttacatgggttctggtatttaacatatgctccaatgggtaagagaacagggccatcatattgttaaagtatcaggcaatgtgaaaattttaagtgctctgtacacagaagaggtgaaggaagctcaatgtaagagagaatgttttggctatgaaaagcaaggacaaacttggggatcatttgtctcaggtaatacaataaaagtatcatttttaaatttatttatgtatttattcgttctactgaatattacattttcaatatatgaatcaatttttctacgtaccgaggtatattggtgatcgagaaagaccaagtacccaaaatatgttcattctaatggaaaagataataaacatgaaaacacatactacagtttcagcaagtgacagagttatgaagaaagttaagcagatctcccagaaagagttcaattttgtgtgtgtgcatgtgtgcgtacgtgtgtgctttctttaagatgggggagttacaaaaggcatatctgtgaatataaaattagagcacaaatatatataaagggaagtgtacaaaaattctgagagggagtagattgggacatggtgagaaactggagatagggtagagccctctggtagagagaaaagcaaatttaaaggtagaaacaagcattctagggaacagtaagaagggatgtgaaaagaaaacacgaagatcaatatggctggaacatcgtccttgcaaaatattatttcatgaaaattacttctattaactttaatcttacatttcattaaatgacaatttctgcttctcattgcttccagaatgatggtgcgcagttttgttttgattttttctatttggaatttgcaatcagcattcttctcattttttgtagtctcttactctcttgataatttcatgctctaagaatgggaatcccttagggatgacatgtttatcctgcattttaagcagttctttaccgtggttactacagtaagttatgtttttttgttcttgcttctttccaataatgtatgaaaatctgtcatcttcttaaacatgccatgctggacaacggaagtctaataacaagccactgaaattatccaattattttaatatacttatttctgaaagatacacttgatgggcaaggattgaaagcccctctcggaatttctgcctggtaccacactcccagtaaattggttatttactacttctgaaaagatggataggggccaaaaagttgcagaggagtttccaagcagcaataaaagggtaacaatatttacgcaaggatgaagtgcccaactgtttaactgtattaagagacttaactctcatgccactaccagctaataactttgaaaagctcattttaaaatgtattcccacacttacacattgctgtaaccttaaagtaagtgactagagacaaattctcttagcagtaaattttccggctgattcccttatgctagtgtatgtcttctagttacagaaaccaggatagctttgtgaccacaaaacaaaatcttatgaaattttattactgctggggaaatataaaggacaagcaatggtatgaattattcttaacgttagggtcccagtgaagggcaacagatggtagaaatatttactccagtgatttttccatcaaagtttctatcagcatttgaatctcagcagtgtggctgttaagaagccgtcaaactcagcagccagctggtgaaatcacaatgtaaaaactgactatacagaaaatatacttgtgtctgatttttttacatcatatgcctttttctagattatcctttaattcaatctgtattaatataaattcacttacctcctatagagttctttgaggcagtagattgccatgttaggtgtatcctaataaaaatacgaaaactcattctctgtagcagatactgtcagtgacctatgcacatctattcagcactcatcatttttgtacaagtcaatgacctttcaacggcagtacctgttagataagggctttctgggctgcgagtgctgaaagcaaggcgagaagaatgagaaaacctgggtatttccattaagaggaggacggtcttttcatggactcgcttgtctcaaacttttgagcaggagtcactccaactccattgtgctctctgaatctaaactcttcagaattgggtcctttaaaaagtgctttagaattttcttcaatcactaataaccatggtaaggtaaagctgaagagcagctaaagggagagctgaagagcagctaaacttggctttgacatttttgtactctttttttgccttctctcaactccaaagcaccagtgtgctctttctttctcccttttgttcctcatctgagagatcacagcagggtcaccatgctataactacatgctttatatgtaattttccattctctctggacatttcacatttgagaaaagggagtgtatttttcttcaatagaatatgacgttaaactataagtttttcaacatttgatggtgggaccatgtgaacattaaaatatgacatatgtaatccatatttacttctgtatgctcaatgacaatgaataaatttttactttcatatcacaaagtaaacagttttttattacatttctttacagcaacatatataaatatattgcacatttaccatataacataggttatggagcagtaaaacacactaacattgcaaaagataccagaaaaccaattagcttaaccttaacaagactatattttttccctaaaaacagcagtttattcatgtcagaataacacactggtgtttcgctccccatgtctgcttaacatttgttgatttaaagcctaaaaaatttcatctaaacaataccactactgttaatgtcttaaggtcgatttcaaatggaataccttaagattttagggtctcaggcttgtatgtctgcgacaacgttctgcaggaaatactggtcatttttaatatggttcattcagcagcattatttcataaaacagatgccatttccattaataaaaatattcagctggtttaaatacttaatctaatggtaattgttattgtttctactggcaactacaaacattttccatctcattctatcatagcccatgttttaaaacttattttttcctagtctccaagaacatgctagctttaaatgttagggcattttataatttctactttcctattttcactgaagggacttgaaagcacacaaattcaccctgtcaatatatgagctaacattatttgtgtcactttccttcatggtgttcagcttttcctttgaaaactcccattaacatttcttcttgttagctaggaaatgagtaggcagaagtgtcagctatctgaaacagatgcgtttggctgaattggaattttcctcaattcctaatccaagagcccttatgctttgagaagaaattatactacataaaaataaggttttatgaaatttccaggttggtttttctgcagtgtggatgtttagagacgataattcagtaaataagtcttagtttgtattgatatgaactaatcacttataaagagtgattagttataataggggcttacatttaatgagtaattattttgtgcaaaatgctattccaagtggctttatacacatctcatttatatttccattttagagaagagaaatcagagacatgaaaagaattaagatattttcacaagattctacaactattaagctaaaggacctgggatttgaatccaatctttctgagtccagcatttaaccacttaaccccctttctaaacttctattagagcctcatgtggattgtcactgttttggtggatgataaaactttgtatatgcactcaattactgcttgtttagtgaatgcattaagagatgctgatatcattcaacgaatttaataaaccaatttgagtggcatataacatgatcaatatttttctcaggtaaaaaaatgggatatttttagagaggttctccatagtggcatggtatattgctctggaatatcttcaaaaagcactaattcatgtacttaattttgtcttttacttgcgacagaggaaaaaaaatagagttgcatggaaccagattatctttctactgctattggcagtcagtatattttgaatgataacactaagtctcagttaaagcactaaattctcttctttaaagtgaaaaaaatatgatgcaatttgatcaaaatacatagggacaagtttacaacatatatctatttgtttatttcatatctaaaagttatttctttactgaaaattgtacatatgaggcttcagactccaacgtgcttctgcgtgtgtttgtttaatatatgggctgcttggttgatttttttcacagtaaccattactggctcatgccaaacaattgcctgctaacagccactgtctacatcctgtcttctaaaataatttcatagtaaatattgaaactcattctcttattcattattagtcaatcaacaaaggccaagatagcagaaattaccaaagctttgatttgccttatcgatgaaggtatcttacggggttgattttacccattttacgataattactcagaatggaaagataacctaaggtacattatgtgcgtgtatatgtattcatgtgtgtgtgcacgctcatgtgtgtgcacatgttcatatgcatgattttggacataaaataaccaggaaagaaataccttaactgtttggggggtttgtgatatcattcacagctcttttctgaaagaatttttccttggacatctagaatgatttttcttatctcatctatagattgagaaaaaatagactaaataaaatggtctttttaaaattatccagttggccaggcatggtggctcacgtctgcaatcccagcactttgggaggctgagacaggcagaccacctgaggtcggagatctagaccagcctgaccaacatggtgaaatctcgtctctactaaaaatacaaaaattagccaggtgtgggggtgggcacctgtaatcccagctactcgggaggctaaggcaggagaattgcttgaagcctggaggcagaggttgcagtgagctgagatcatgccactccagcctgggtgacaaaagcaaaattccatctcaaaaaaaaaaaagtatccaattgaggggaaaagttttgataaaatgttcatcagtttcaactaaaccacactgtcaagaaatgaggaccattagacattctctgaaaattttaaattatgatatattcacaaaattgtgtaatgttaatgtattaaaagatcaaattacatcaaaatagtttgttttggacttgttttcaagttggagtaaaggaggctgaacttaatctcctgcctgaaacacctgaaacacttaaaaaaaaaaaaaaaaaaaaaaagacaaaatatatgctacaacggttttcaacacattgaacatcagacattgaaggacagtgatccttgccaggaggcttttgttaaaagatgaagctgagagtttcagcagcccaaggctgactagtgatcacagggcaaaataccagagaggtgatatatacacagaggaaattttggagatttgtagaaagctttattttattcttcatctgagtcttgatcagttcatgtatgcaagaaaaccactcaaagctaaggaaagaacttcacaaaagaattaaaggaaacaatcaccagagctcacacgtggctagtaataccacctgttcccacgagccccagtgaaaaattttatcattcacaggacatcagagagagtactcagaagggttttgcctcagtagtggggaaaaagtagccctaaacttacactgttctggtcataacaaagcataaaaggaagattctcaaaagatcaaattgtttccaagtgaattaactgtgttccagaacgaggtttgagaatatttatttcaatatatttgaatttatttgaagtatcaagcacgcgctaagttaaaattcacaatgtctggcatatagtcaaaaattaccagtcatccaaagaagcagttaaacaacacacttaatgaggagaaaaataaatcaatttaaattaacccagaatagacacagatgataaaattagtagagaagaatattctaacagttattatatctgtattccatatagtcaagaaagtaaagactgaacatgttgagtagacacatggaagaaataaaaagacccaacttttacttctaagagatgaaaatgtctgatgttaaaaatatatactacatgggattagccatagattagactttgaaaaagattagtcaatttgacaatagagattatataaaacaaattacagagaaaagagagaccaaacagacaatgaacataacatcagtgagtagtggggcactttaaggagcctaataaatgtacaattggagttccattttttttaaaaaaatggttgaaaggtttctaaatttgatgaaatgttaaatgcacagattcaagagcttaactgacttcaagaacaagaaacatgaagaaaactacaccaagttacatcaaaacaaattgcttcatcgtaaaagtactccctagttaaccttctacatacaaatctccattttacaatggctttccaagaaacccagcctgaaatatgtagcaaaattcatactgaacaactatcctccaaagagtagaatggaggtacttttacaaatttctatgttacttgatttttttcacaataagtactaatttgataataaaatataaattgaaatatataactaccttgggttggatatcattgaaaatggcaagtggtttctatatctaccccaaaacattttatataactctaatatgtttctgcctctcaggcagaaaccccattatgctacattagcccaaaattcacttcagtgctatttttaaaatgtatcttctatattaaagcagattgggaatccatacatttcctctctatacaaatgccaacgctggtgtgcatgcaagtttgattgatacacatataattacacaaggttttaaaaatattttctgtgtttaaatagcttatcatataaataggtgtttaaatgcttaactccttaatattaaagggcatatttactatggaaacatatttgagaatgaagacttgtaaagtcaaatgtgatactgcttttgtgaatccagcattttgaaatatctaaagtatttaataaactactgggtgttttttgccctcatctgtcttaatcagtattttctggcattaaaaattggctacaattcaaatccacttgattgactattgcaacatgaacaatttgagctaaaaaagatgcaaaaataattaagtcttcgtgtaataaacacagtgtttcttatgcctaaactatgtaatttagcaaccaaattatatcctggacaatctaatctatctttacctgcatattcaaaggacaccacaagttgaaattaaactacacactggttatcatccatatgctgtttccctattaacataaaccataaaatgtcaataagtaccaacaattaactctgcattgttttggcctctggactatttcagaaggcattttgtcaatagaatatatagaaatattgctacagcactacaaaattgtctttaggaaaacagaactgtaattttatcatgatggatatttctagcaacttcattttagctaagtatgccacaagttctccttctggaaaggttccaacataaagccgaaatacacactgccccaaagccacaaaacaccttgctgttacgatgcttccctctgtcacagattcaattatattttgcagtttatcagataaaccagctccgtccaggcaaactctctcatcctgacacaaaaagtccatagcaccgtgctctaatattatcattatgataattttctttctagtaatataatgatgacaacaacagtcaaaagtaatttccatcacccttcagaacctgatctttaagaagttaaagagtccagatgtgctgaagataaatacaatttcgaaaaaacaaatcaaagacttaccttaagataccatttgtatttagcatgttcccaattctcaggaatttgtgtctttctgagaaactgttcagcttctgttagccactgattaaatatctttatatcataatgaaaacgccgccatttctcaacagatctgtcaaatcgcctgcaggtaaaagcatatggatcaagaaaaatagatggattatgtaaaacagattatagagatatagcgtatattttttggttatactgacaaagatatcactctgatagtttcctgcatttgcagagtttagtttcaagtaacaaataaaaattaatatacacacctagcatgtacacacaacattttaaaaaaatactcaatataaaagctgattttaaatggaaggttgcaatttttccctttaaaatgaatatatttattgattaaaagaaagataaagcaactattttggactattggcattttctttcctaaaaatatatttttttaattctagaaatttacaaatatcttaacattgtaataaattatttggaagcaatatattccctttcaaaatatttttggataaaaattacttcataaattctatcactttcaatattattcttgatccaaaactgcctgttcatcaactgaaaggagtaataagttctagtgttctattgcatagtaatatgaacaaagttaccaatattgtgctgtatatttcaaaatagtgaaagagaattttaaattttctcaccacagagaaattataaatgtttgaggctatggatctgccaagaaacctgatttgatcattacacaatgaaacattacactgaaacgtcacactgtaccccataaatacatatagttattacaaataaaactttaaaaatataactaaaataccattatcacaccaataaatcaataattcgtcactatcattaaagattctgtcaatatttaaaataagatgacagatataattcatattgtaggctcacatgtaagcattaaataaccgatatactaaactatgcgatgccttctttaatccttcttattttattgtagtcactaaaattttagattggaatactgcaggaacttagtacaagtcaaatgtgttaatactacacatggaaagaatattaggaaacaagcatttggtcaccttccagtcataaaagagactgaggcagaaataatatgaaccagggctgtatgtttacctaagacagttgcacataagaatcaactggggcatttaaaacacagcaacaacaataaccaaacagtgatcctggggctccattccagaccaacttaatcagtatttctggaggttggacactgacgctgttatttttcaaagcatccaggtgatttcaatgtacagtcaaggtgaaaaacactgccgtaaagtaagatttgaaatcttactgggcttacagtctaccagatttcctggggcctgcccaagcaagcatttgtgagcacaaaaccaatagccatcctacagattaccggctatggtgctgcctcagagtacaggaatctgtcaagcttttctgaactctattcttaagaagcaatggatcatacttttgaataccatgatatcttttcagtcctctaccttcattcaggaatttaaagtaacactagaagttttaaattgctacatctgcctactgatgtcctgggcagagaaaggaattaacatttattaaacagttactaatagccaggcaccgggctctgtgcttttatagtgccagacacatcatttcattgacacctacaataaccctgcagcataacaattattattcccattttccattggagaaaacagaggccaagtaatttgccaaaaggtgaaaatggtattaaatagtagagagaggcttctaacccaaatatctcttgtttcaatggcacttttctaccagtgcacatgctctcttgtgaaattatttttccaagatgaagcttcactttatcagttaaacaattaaaagtgatagttctagaggttttttccccttatttttattaactacccaaaatttaataatgtatctacatgtacattgcactcattgtatttaatgaataattatatgcttaacctttaaaatcttgtaaaacagacagcattttggtagcataaaaaaggcaaccgaaggtagccgaagaggtattctctaactgtagttagtgaaaaataagaatgttgcctttgatgatttatggtattctagagttattcagatacaatatatccttccacaacaaaatgatcttgccaatgtttttgcatgtttactaataatttagcattcatatattttcaatggtatataacacacaataaatgacctatgaatatatcgtaagtttattccctttaaaaatgaattgcacattgcatatgttacatgcatttgcatcactggagtcaaagagttgcttttgaatgagaatctaaaaatctatgcaacatagttagcattgttccatactggtgagactatattttcttatataatttttctatatttttcaatttgtctacaatgtgcttttcatattgagagtcagaaaaatgaaataatttaaaatttttttttaaatggcagtctcatatgcaaatgactgctaactccaaccctcctcctgctaccacagtctgagaaacagtcagcagctaaccagagcacagagaagtaccagttggtcacgacttaccactccacctttgtagcaaccatcagtctccactcttggtttgctgtttttcctacccaatcacttgaactatacttttgccaacacttttagctactaggaggtgactgtttctctgacatactgctataaatgcccattcttcatttcaggatcctgtacacctcaaagattttcgatttcaaacctgttgcacagacttgtttctcaatcactcatcatattggtaattgccatcctctatcaaattcaacaaatccccctctcaccctgaattcttttcctttttacaagttatctacaagtttctacaagttatctttcctttacattctcccaagagaagaaaaccgtaagggttcatacacttgctcatggtatccgtagctctgtaagacagagctggaggtaggaagagaaggggaacaggccttccacttacaccattgttccaggcccacaagagggaggcaggatggactttctgcccgacccctgctactgtcttaggacttgtgaatttgcatatcggtagcatatttctgaaatgcccttcttccctttttctctcgtctcctcgtataatccaaacttttgcatcctcaaggacctaataaaaatgacttatgctgtcactttataaatatataaatatgaagtatttattacagcatgcaactgctaaacctttgaaaactgtaaagttgatttaattttattattgaaattactgttgaaataagtaactattcaaacaaaatattaaagaataaaatcatgggctttacatgtgatgacacttaatgtgagtaataatactttagactccatttcaagcctcacataaaattttaaaatacacttttcagtatttaataggtgctgttaatagcacagtctaaatctattcttgaatttactacgtaaaattacattttttatcatgactacttttaaactcttttccaccaaggaaaattccaaatgaaaaaaatatatatatattttttctggttttacaaagttagatttaccaatttaatatctaattagtcactgtgctccctaaatttgtctcgctccattaattgggctgcccatgaatgaagcaaatggtaacaatgagaaacaagtagagacatcaaaaatagcattcagggaaacaaatataatttttgccttctgtaatatttctaggaaaaaaagttttttttcttggcagtaagaagaaatatggatggaacttaacaaagggcaaaaaaatgtcagtataaacataaggataataaatcaagtgattttagaattttgcaaatattaaaattctcattcaccgtgcaaccggtatttaaaattacactgctgcttcatttatgtgcagcataacttattttctgatgttctaaatcaagttagtcagattattctcaagcataaattacatttagggagtaattcggtactctggggcatactttaacactttcgggccattaaggtggtagtaaattccatgaaatagatttaaataaataacaccctagtagacttctgacatatccattgttgctttatacttcggtctggaaactcagcattggactgctgattatttcatcccatcccacatatttcatctttgattaggtgaggaggagggacctgagctcgtgtctcatggtccaaactgtatgtgcgaataaataagttagttatctgccccaaatcatagtaccttgctacttctccccaaccctcaacttcccaagtaatacaaatatttagtaaaagataagtatactaccaattatgaagtacttacctcctaaggttaattgtgggagctcaataaatgagtatatataaatttctttttttacatcttttattttattaatgtttttaaaaaattcaaattcaatagtctttggaatacaagtgatttttggttacatgaatgaattgtatagaagtaaaatcagatattttagtgcacgtgtcacccaagtagtgtacattacaccccaaaggtaattttttatccctcactaccttcccactctgccccttctgagtcttcaaagtccattctaccactctgtctgcctttgtgtacctacagcgtagctcccacttataagtgagaacatacagtatttggttttccattcctgaattacttcacttagaataatggcatccagctccatcaaagttgctgcaaaagacattatttcattattttctacggctgagtagtattgcatggtatgtggctgaatagtatttcacggtatatgaaaatatatgccacattttctttatccactcattggtcggctggcacttaggatggttccatatctttgcaactgtgaattgtgctgctataaacatatgcgtgcaagtgtctttttgatataatgaattctcttcctctaggtacataatcggtagtgagatttccagatcaaatgttagatctacttttagttctttaagaaatcttcatactgttttccatgtaggttgtactaatttacaatcaccagcagtgtacaaatgttccgttttcatcacattcacaacaaaatctattcaaaacctctgggatacagcaaaagcaaggctaagaggaaattttctagcaccaaatgcctacatcaaagagcctgaaagttcacagtctgactacctaacatcacacctgaaggaactagagaatcaacaacaaagccaacacaaagctccagaagaaaagaaataacaaagatcagagcagaactaaatgaaattgaaacaaaaatataaaagatcaatgaaacaaaatgttgattctttgaaaagataagtaaaattgatagaccagtagttagattaaccaagaaaaaaagagagaagattcaagtaagctcagttacaaatgaaaatgcaaatttcttaaaacagcatctggcagtgttccacaagtatgagtagtagtagttgttgtcattattagtgtacctctatttggcttaagactttaaatgcaaataaaatgaccaacatagaatctgagccatgctagtgtctctctggtggggaatagacccacccataaattagaaattccttcttgagaaattaccttctttaatttcaggacttaaagtatttaaataggcagtgtcattagcctgctgatgaaatctgaatcattatttcagcatagaatccatggttggccatgcctatccctgagtacattacatatatttactttttaaatgctttttgttgtgaaacataatatagggaaccattcatataaacccatggtgaccatcacccagaccaagaaataaaacttccagcagccaaatggaacactctatatcatagtttcaagattaatctacctctttgcttattagttgttgattaatttctcactgtatgattgtcttagtctgtttgtgctgttataacaaaatgcctgagactgggtaatttacaaataataccaatgtattcactcacagttctggaggctgggaagtccaagataaaggctctggcatttggtgtctggtgagggccttcctgctgtatcttcacaaggcagaaggtagaagggcaagagagcaagctgactgaatgctgcgtgaagccttgtttataagggtcttatttttattaacaaagaaggagccctcatggcctaatcaccacttaaacaccctacctcttagtactagcacattatcgacacctgaatttggaaagagacacattcaaactatagcaaattttactattaataaatactgaagtagttttggtttggggctattactatgctgctatgacattcccaaacatgtctcctggaatatgaacatatgcatttctgtagagtgtatatatagaagtgaaattggtgggctataggttatgcagatctttgaatttactaaatagtgccaaatggatttcactccaagaagcagtagtgtaattttacacttctatttacaattcacagaccaagtaacattgtgtgaaatttctaattgctgtatattctcaccaccacatggaattgtcagacttataaatttcaatgattctggttggtaagcagtgatatttcattttagttttaatttgcatggcctggaccattaatgggacttagaaattctttatatatttattggccgtttggatttcttattttgtaaagatgacaaaaatcttaacgttactatgatgcataaaacacattagttatttactataaagtgatcaccttaaaaatgccatccaggtcaagatacagaatattgccagcaggccacaagccctttttgtgccatggttcacttttcaagaacttttcccatttttctattggattatctgttcttttctgaaagatttgtaggaattctttataattatgaatacacacatttcatccattatgtgtgtattccaaataatttatcctactctgtgggtttcatttttactctctcagtgctgtcttttgatgtatagatgttattaatatacaaggtagtccactttattatttttattcatgattagtgcttcatcatttgtgtaagcaattttttcttaccctatattaattaacatattctcctctattttactgtaaaagctttatcaatttgtttttttctcatgtcagtttttagtcacctgggattttatttttgtatatagtttgaaacagaatatatacttttttcctaagcaggagactccattttaattttttaggtaaaacatgtgcactgtacaagataatgcatgaacagcagaaaaataaaagtgtgtgcagtgaaaagcatctgtcccaattttgatctgctcactctggtagttctgctctcactgttaataaaaattttataattttaaatatttatagaacaaggcaaagaaataaacacagtgatataaaatgatagtctcctcattcagttttactgctttcaatatattcaatgctgatatttttacaactctggattgacattatactttgtaacactctattttattgatccctaatcctccctaggttgtgagccttgttctcaggcttcaaatacgtttggagtcatactttgattttaagtttctcacagtgtttataatacttgagcttaggaactcattctcatgcctttatcccctctcttcgctgttgaaattctacacattttttcccttatttctcataacttcacttattgcattctgaataaacagcaaagataaattttctttgacctgtaccaccaacatcaacacctaaagtgacctctttcccattataggggactcttctactgtgcttaatggagactaggatgtgttcccctcaaaggaattctagtttttataggtaaacttgttaaatgtcttgtatggacactgccttatgaaacctcatttgctttcaaagcttcaactaacatctacagcaggtattggcaaactttatagataaagatcttgagaacaaatatttcaggctttgtgggccgtatggtttttgttacaactactcaactctgccttgaagttcaaaaaaaaggtatacatggagcataagcaaatggatatggctgggattcaatactactttacaaaaacaagtggtgggtgtaattggcccatgggcaggagattattgactcttaatctaggctgattatgacatagctccaaatttcagcccttatctgaggtatatagccaactgctacttggactatcctcatcagaacatttgatgtgaacctcaaagatgttatgtcaacaattccttattttcccatgcaagtctttgatatgatttggatctgtgtccccacccaaatctcatattaaattgtaatccccaatgttggaggtggggcctggtgagaggtgactggatcatcagggtggtttctcacggtttaataccatcctcttggtactgtcctcatgaaaatgagtgagttctccaagatctggttgtttaaaagtaggtagccacccacccccaccaccaactctctctctctgctttcgccatgtgaaatgcctacacctgctctgccttccaccatgagtaaaagctccctgaggcctccccagaaacagatgttgctatgcttcctgtagagcctgcagaatcgtcagccaattaaacctctttactttataaacacccagtctcaggtatttctttatagcaatgcaagaatggcctaatccagtccttagttttaattttagtcaatgatttccaagctagaaatcttgagaccatcgtttacttctcgacttctttcttatcatgcttgtctctatattttatcaattctaaaccagaaatgactctttaatttagcctcttctctctagccccactgtcgtggcctttcttgaaaactcctaataacttttcctcagcatattccaactcatctctccctattttcggtttctcagcgctctctaacagacaacctcacttcctactttggtccctatacaaacattcacatagcccaccatgtatactgtactgaaaacatagaaaatctgaaaattttcataacaaccaaaattccttttttactgtgggccttttgctgtattttagaatgacaccctatctaaaatgtcactattccataaggcttctctcccttggaattagttacttcataagacaagcttccacagctttgtgaaaacctctattaacatactacttcatgttctaattatgtatttacaaggctgtttgttccagtacactatgtacctcttagaataaggaagatgttttatgcacctttgaattcctggtactaagcgctgttcctggtacatgataaatgttgaatacattttaataactgaatgaatgaataaaaaagtccatgagtaatttcacaaaccccttatatcttccatttaagagccatgaatgcttggatacactattttacctctgagtctcagttatctcacacataaacccagaataatactgcctacctcattcagctttttcaggaggatgaaagtacactccaagttataaatagcaataaaatttagtattatcgatattaatacagttagtaatctataaatttttaataccgacacagaatttagaataaaaaaatcaatctacatcagaaatcattttccaaatatatcagcaatcacataattgttgttttcattaataaaagacacaaaatgatgattcttaaagataaataatttagcaagttcaacaccatcctaaaaagaatacactttgcacaaatttactgagacctaatttaaatatgaggatgcacatttagggactgtgactcttttaaggtgagtgttttaaaccaaaacaatattgataaaattcaccctaaagaagtcaatagcattatttaaaaacagatgattggataaagaatatgtggagatatatctccacatattcttttatttatatgtgtgtgaatgaatgtattccattgtgtagtattccattgtgtgtctatcctagcttctaagtctaagcatatatatatatatatatatatatatatatatatatatatatatatatgtacacacacacaaattgcgtatggaataaacaatttcatatacacaatgaaaaatactacaaagccatagtaaagaatgaaatcatgtcttttgcagcaacatggatggaactggtggtcatcttaagtggaataactcaaaaacagaaagtcaaatattgcatgttctcacttacaagtggaagctaaataatgtgtacacatgcgcacagagtgtggaataatagacactggagactcagaagggcgagagggtgggatgggggcgaaggataggaaattgcttaatggagaaaaggtacatcatttgcatgatgggtacacaaaaaaccagacttcgccactctgcaatatatccatgtaacaaaaatgtacttgtataccttaaatttatacaaacaaaaaaataataaaattacttaaatgttgattgcattatttgtaagaactcacaaacaattcaggttatcactaagactattaaaataaatcttaaaattctttagatttctaaagtgttgtttaaactttgctggactcttattgggcttaaatctctagacaggcagatctgtggaggaggacgctgtaacagaaaagcctcatcaataagctgaaattgctttagataaacgaggactttttgatctgaaagtgcacacaaaaatacatatactttaatatgtatataagtatacacacatatcagaaacttggcctgagtgatttttagggggctaaggggaccttaattaagcactctattttggcttaggggaaaacaccgtaaatatccttgagataaattgataagtactcaaatagttagagattcatttctttacctatgcttggtatctgattatttaactccttagtaataacaaagaaagcaaaagtgtccctgatattactattgtctagaactccgcaaattttctttgcccttctcttttataaatctctttgacacaatataatgttccagcagacaactgacaatgtaaaggttgtgatatttgaaaattccatcatgatggaaaaatattcagggtgtactattcctgcactgcttctgaaaaaatatgtaggattatgctaatattaacctaaaattatgcaatttcaatgtcttgatttggcacaattagcaccctgtaaaaatacccaaagtagcagaaatagtttgctattagtgatctgtaatgctacttttaataccaagaccttttggagaaatcagctacagaaactgactcagcaggctaagttaaataatttaaatttcttaataagtttaaactgacatactctctgaggatttgatatattcaagggtctcctttataaaatgtgagcatttaattgagtcttaatttacatatcctctactatatagtccacatgaagaggatatggtgttagacatcctagcttccaagtcttagctttcatttgttggctagaggggatatttgaaataatgatgcctttctcttcattcaaacacaaaacatatataataggtgtaggaacttttacccagaaataggagcaaaagcaaccacaaatatatgctatgcactctaattaaaacttcagattaagtacatgattaaatatactccacagcaccttggggtaggtactatcattttattcattttgcaaatgagaaaactgagactttgggagtctaacttgtatgtttctaatcaggaatgcaagacaataacatagctgaataaggatagcttatagtgtatgttttttgtttcttgttttttttaagtgtcatttgaatcagtaaacactgtattagcttgtgaaagagaaaaaatcctacttctcctataatatactatcctcttggaaataaatcatgttgttattggatagttacactcacgtgtttctgatcatgaaatttatatttcaaaggaatggattaataaataacctaacctcctttctaagcagcatttgctcaaaataacatatttctagacacttctcattatatatcatgacaagtacctcatactctcaaatcaaaatggaatttctcttgatttttcagaaacatccttggtggttcttcatcttttggtttatttttgtttatattattccttttcttaaagtatcgttgcttatattgtcctaaatttttctataccttcctccatgagaacctttctgatactaccaattagaagtaatccctcccctctttaataacactctttttattagggtgattatttttcttgattcttttttgtaaccaccttaatgaagtatgattgacatacaaaaagctgtacatattttacatatatatatatatatctcaaagagtttcatcatatatatatatatatatatatatatatatatatatatatatataaaatcaaagagtttgggaataagtatacacccacaaaaccatcgccaccatgaaggctataaacatatctgtcatcactcaaaatttcctcttgtcccctttattattgttgttactggtggtaagaacacaacataagatttcttaggaaattttaagtgtccgaaacagcattattagctataggcactatgctgtataatagatctccagaattttatcttccataactgaaactttgtagtctttaacactccttttgtcctgctttaaagaatttattctactctaatttacattagtgtcattacgtctaaaccacactaaatgctccctaagggtagaaactatattgaatcaccatttttacctcctataacaggtgccaaaaaataatgttgcacttaatttttgcagattcaaatttatccataagtaattttaatacaaataattggtatccacttcaaatgagtataccttctgaaaagaaacatggttttttttgttttgttttgttttgttttgttatttttgagacggagtctcgctctgtcaaccaggctggagtgcagcggcgcgatctcggctcactacaagctctgcctcccaggttcacgcctttctcccgcctcagcttcccgagtagctgggactacaggcgcccgccaccacgcccggctaattttttgtattttttagtagagacggggtttcaccttgttggccaggacggtctcgatctcctgacctcgtgatccttctgcctcggcctcccaaagtgctgggattacaggcgtgagccaccgcgcccggccaaaaacatgttctttagaactcccaaagtatcatcttttagtatgaagattttttttgaaattaagaacaagtagtaaaacaatcaggttgtacagcatacaaaatttgaagacaagcaaacgtgagtttgaaattctgttttattgcctaacagtgctttgtaaacttcagcaagtgatttaatttcctgatttcagagttctcatttgtgaaataggcataatatatatttcacagggttgttataagaattaaaaataatacagtgaagttttctgagcccatagtaagtgctcaatggtggcaataacaataatcataatatccaaatatatatacagtatataatttctgttatttagaaaatattaagttatcaaatacatgtacacatatatgaatattttcaatatctatgaatgaggaaaatatgtataactgattttatacatttcctcattggcacatgaaagttgtatatcttcagctaaatttagtcttcttgccctttaaggctcaaacattttactatgtgtaaatgattttactgctattgtaattgggcaaaccaaaacaattacagtaaatggaatcatatgtctttgtttcgttctcaacgagggaggaacagtacacttaacacagctacaaaaaaatttaacttacttttttctgctaaaggaaaatgagatgaaaaagccattttattttaaaacgaatggcagattttgatttcgaggcaagtaaggcaatttcgtgttatcttcccaaaagtatggtgagaatacgaattccaaatatgcggagtatgaataaaaaatagaaaggtatgacatttttcttcttaggcagccaaaatgatatttcttccataggctgctgcggcaaatcaaaatacaccacttgagatcagcttacgaaaatgtcccttttacatgggactcattttctttggccataaaaaattaaagattaagatctctgtctatctttgaatatatatggcatgagaccacacttacaaatacataaataaaactgaaacaattcactttttacttagctttattctaaacgggaaattctattttctctcttactactattctactttctctattttctctcactggcaccattaccttccacaagactgtttttcctgtgaaggtagttataattaacaagagcctatacacacataaaagttttcatttaccatattagtgaacatatcaagctatcatttttcttaatgtttactaagttttactttattgaaaccaatctcaaaggttgcagcatttaaaaaagtgacatttataattctcaattataaaataattttccaaagaaagaaaaaaattccaattttacttttataagttggaatttactatatatacacacaaatatagtatgatttgtgtgtgtttgcaacacacaaatatagtattattgaaaaaggaggaatttagatgttccaagtggcattaacagaaaattagttctgaaattatgccagattagcatttcaactagaaattatgccagattagcatttcaactagaaatagcaaggaaaaacttctaggctataagaggtcataagtagtaaagaaaataagaactattttcaggagacatgacctattctgccgggagttgcacccataaggcagagggaacgggtccaaaatattttcttataaaaatagagatacagtaattaatttcaaggcagatttcagtttatctatttttgataaatttgttaaatcaattaaatatgccaggggccccttattaggagtatggctgtaaggctaattttagtttgaatctactgacaccataaacattaagaggatttcacccccactcctacccactccctagcctgtatgtaactgtgggagcagggcagttccaggatgacaccatgttagaaagacaacttcactgcaaatttactgaactgaaatctgacccaagtatagcagctctaagtcaaagaaaatgtcatcacatctgacttactaccttatgagtaaatatcatcacaaaagtcgggccccttttgctattttatattctatcttattaaaacacaggtgcacgagggaaatgttcttggcataaaactactacattcattaaattttttctttcccacaccggaaggcacatgtctaaacctgtaggggttgctttattatttaattagagcagattcttttctatcattttaggtgtttcatctaaagtttgattaacatcagtatatgctgtgctctcaggcaagtaaatatagctgccgtagaaagagaaataagcagaagcaacattttaaaaaataaagaataacatgaacatggaaagaaaaagaacctttaagaaataaaatatccacaaagctcactagaaatgcttcctaaacgtgtatgaagcgtatgtgtttgtacattttatttcaccactgattcatttactcaatcttttgataaacatttattgagcgcttagtcctgaggctagcagtgtgttgaattcggaaggtgtaaagctgaaaaagatactatctctatcaatgggcaattgacagtttagttgcacagtattttaaggagggtatgaactgaagttgtagcacatgctgtacttgctccatgcacttccccttgcctttccatttcaaaatacactggtttgacttccaaatgccagcatttggatttcattacctatggaatctttctggttgcagaggtctgatgctgatgttactggggtggggagcatatttttcaaccagtggcatggaaggaatggcccaagggctagttgggcaagatgtactagatcaacattatgaaggttcatgaatatcaaagtttttgagttcatttatgcagaagtagtttattgcaaaagagtaccacacaaaataaatagctgcagatctttcacaatacaataaattaaaaaaacttcttggagggggagaatatatagagcattcccaatccacttcctggtacaatttctttttcttttatttatttatttatttatttatttatttatttatttatttatttattgagacggagcttcgctcttgttgccccagctggagtgcaatggtgtgatcttctctcaccacaacctatgcctccagggtggaagagattctcttgccttagcctcctgagtagctggggttacaggcatgcgccaccatgcctggctaattttgtattttaagtagagagggtttctccatgttgctcagtctggtctcgaactcccgacctcaggtgatccgcccaccttggtctctcaaagtgctgggattacaggcatgagtcaccacacccagcccggtacaatttcttaggcttcattttgtgccaaaattgtatatatatgtaagctatacttcaccatgttttccattaaccctacaactgcgatttcggcagcttcatgcttctcaagagccatggtatgggtcacagtaaaactggctggtccaccaaatagacagcagggacggcagtggtgaatagtcccatgaccacgagagaccagaaagaattagttgtctatagctactcttgtctgtgagattatagttcattttcgccttgaaaggaaggttttagttatgttgggtcaggaaaagacagatgggttattatttattgcctatcagttttaaccacgtgcaaatgaacgttatgcaagatgagagcataggagaagctagaagtctaatcagttcttgaagaaggaaagtgaaattgtgacatttgacatttaaaaatataattttgtaagctataaagaagggggtggtgagaagttagaatagtggtttgcaaacttgctgtacaatggagtcatccaaggatcttaaaaaaaaaatacaccagagatctgattcaactgatttgggacatggccagggcatcagaattttcacccaatattttaacataacaaatttcaaaaatgcaataacatttttaaaaattacaagtgatatctatatatctagattccaccatgaacattttactatactcgttttgatcacatatcttttccttcctccgatccatccatcaatcaatcatatttttgatgcatatccaggtaaactgctgacatcagtatcattcaccttaaatacctcaatatggatatcactgaatagaattcataaggtttctttattattatgttattatttactgtatttggtgtcctctttaccttatggccaattcaagtaataactctgcaaggtagttattacttagaaggaaaaaaagattcagagacattaagtcatcttttaatgttcacatgggaagtaaaaggtagagttggattcaaatccagctttcacttatcccataaaacagtggtccctgacccttttggcaccaggaactgattttgtggaagacaatttttccgtggaccgggttggaggatggtttccatatgattcaagtgcattacagttattgcacacattatttatattattatcacattataatatataatgaaataattatacaactcaccataatgtagattcagtgggagccttgagcttcctttcctgcagctagatggtcccatctggggggtgatgggagacagtgacagatcatgcagcattagattctcataaggagcatgcaacctagatcccttgcatgagtagttcacaatagggtttgtgctcctatgggaatttaatgtggctgctgatctgacaggaggtggagctcaggcagaaatggagtgatgaggagcagctgtaaatacagatgaagcttccttccctagcccgctgctgctcacctactgctttgcgaatcgggtccctaacaggcaacggattggtacgggtctgtggctctggggttgaggtaccctgccataaaatactatatttttttcatttttccaaatgtctctaatgctatgagggtagaagtggaaaggagtcgaattagatatttaatttgaagtctacccattacaattttggaaggttagaggccaaaagggggtgtatcttgttttattttttcaactttttctaacatgacaactgttgaaaaataagtatcatgtacaaaaggtaaataaaagtggccttcactttgttttcatttggagtatttattcatcttataatgccttaacatggatttttaacttaatgaaatcgcccttaaatttgtcattaacagactattgttttagttttagtgttttttaactatgaaaatattgtcattgtattaaaaaataagaatttccaagttacaaaatgacagtgaaaaaaaccagccataccattccaccctcacataacagctatcaggatgaagaataatttttctctttatcatttattagttctctaacctaattttttaaggaattcatttaaaatcatggtaaaataaaatgaaaatataactaataagatagtatttgaggtgataggatttcctcctcagcaatgaaaatcttacataatcatttaaagaccggtgaagtgctgaaaatcagacaaaattacaatgtgaaaatcatcaagaggaaacaagtctattttaaaggaatgccaattagactgacaacttaccgttcaacagaaaatatggaagcctgagaacaatcatgctatcttcaatgtgattaactggaatgctgtttggtaggacatgccatcctcagtttaactagattattgctaaattacactctaaattggttgtaccaacttaaatttctacaagaatgagagtttgtgacctttcacaatcttattttattttttacttgttccagtccgatgggagtacgttatctcacttagtacgatatggtttggcagtgtccccacccaaatctcatcttgaattcctacatgttgtgggaaggacctcgtgggaggtaattgaatcatgggggcaggtccttcccatgctgttctcgtgatagtaaattagtctcatgagatctgatggttttataaaggggactttctttgccttctgccattcatgtaagatgtgacttgctcctccttgccttctgccaagattgtgaggcctccccagctgtgtggaactgtaagtccattaaatcctttttcctgtataaatgacccagtctcatgtatgtctttatcagcagcatgaaaaccgactaatatgaagtaatttttccaataataaatgagagttagcatctattcataagtgtatttgacatacagatgttctgtgaactgtctattattttttaaactttaaaaatattttcctgttaggttatttttattttgttctattgataggtaaatatttttcttaaattatgacataaatcctttattgttttagtattgcaaatatactatctgagcctatgtcttttctttgtttatgaagtctttgcattgtacaggtttttaattaaaatgatcaaatatatgtctttttctttacaatttttgctttgtgctgttgcttaagggacacctcttttgccctacatgccccaaaatatttttatatattttaatgctttgcctttcatgtttaggcaatccatcaatttaccatttttatgtttatgtacagtgtgagatagggatctaattcttatgtttaataaaattttaaatggtacttctgtctgtcatacatgtcatatattatactcttacacaataagaataccacctctcaatacattcgaatacattagattttttttttcttggtaacaaaattcctggagcactattttcttctccaatctgtacaggtttctctctacaactgttatacagctgttgttacaggatctcctccaccatctttctggcaccactttgcatcttcctcccacgttgggttctctgttttccggatcctaggctttgcaggtaatactaatgctccaatattttcctaattctcttacctctcttaaaaatattagtgattataatcccctgtcccctcagagttaggcatgaccacgtgacttcctttggatgatgaagtgaaatgaaaatgacatatatcactcctacatagaggcatgtaagagtcagtttaaaattttccacgcatttttgactgacatggtgaacgctaaagcttcttattgttacggtagaatgatagaatactagagactgaatcagcttagattcctgagtgactacaatgatcagaacccttgactgacttgtgttggatatgttgcaaagatacaaaatcaacctttgtgtttctagccactaatattttggaattgcttattattgcagcataacaaggcgaatcatgcctaaaacactctccttctgatctccaatcacaactaaacattctttgtctttcttggtttctttcttcacttggtagagtatatttttgaaaatagatttctggggaaaaaaggtttaggggagtacataaggctatctctgaaaattattttctccgcacaatttatagtttatcagggtgtacaatttatatattgttgaataacaagtcattccaaaatttagcagcttaaaaacaaaaatgtttattatttggcagtttctgaaggtcaagaatctgagagtggcttagcagggtgggactggcatagcttattttatgaggttgtagttaagctgttgtctatgcttgcagcctctcgagatttgtctggtgttaaatgatgcacttctaagctcattcttgtggctctttgcaggaggccttagtttctcagcatacgtgcatctccatagggctgctcatgacatgtgttcccacagaagaagcaatgcatgagagagagagagagagagagagagagagaaagagagacacagagagagataggcgtggatggagaacacaagacataaaccacagtctttctacaacctacacttggaaatgacatatcatcacaaaagagtcactgaatctagtccacactcaatgacagggacatttagctgtaactcttgaatagaagagcatcacagaatttgtgaacataatttcatataggatatgaaatcaaagccaaagttaattattcctagaagtttaaaggaagtgttcctttctgctattttccatggctattgctgaaaagtccaaagccattctgatttctgatctgtgaacttctctttgtccttgtttttgtaaaaatttatgatgatgagccttggtgtagatttttagctcatttgctgtgctgggcatttagtaagccctttaaacctggacactcattttcttcagttctaagaaaactgatgttgtcacttctttgataattttctctccacagttgcctctcttctgttttatttttaacatctattatttgaatgttggattacatagaacaaggtttctaaacataaacactattgacactttgaaatgagtaattcttggttgtggatggctgcatggtgcattcctcttgcgtcactcttcacaagaggccagtagtacatcctttccttatttgtgacaacgaaaaaggtctccgtacattgtcaaacgtcctctgcaggacaaaatcacctctatttgtgaaacacttacctagaatgatcttctaagattcttatactctcccattttccatgcttttggctatttatactgctttatgagatatttcttcaaatttatcttctacttttgaacttttatttctgctcttcatttttaatagacttgattttttaaagcaattttacatttatagcaaaatcgaggggaaagtacagagatttcccgtatactctctggcccccttcctcattacacacagcctaccccgctatcaacatcccacaccagagtggtacatttgttataactgacttacatacattgatatatcattaacactcgaagtccatagtttacattagagtttgcttgtgatgttgtatcttctatgggtttggacaaatatataatgaaaggtatccaccattatagtatcacacagagtagtttcattgctctaaaactgctatgcataccatgtatgttattccagtggtggatatactaaaagctctgccttcaccactataaaatatattcatataacaaaattacactggtaacccataaatttatacaattaagaatttaaaaacttaacctgctatactattaatttaaataacccttatctttctcggaaataccaccttctatagtctcttgttctttcttatgaatacagtgactagtctcactgtgagataataattttatagctatctttaaaaagttttcttaaggtctatgccttgtctctctttctgcagagatttctgtttcatttatgtggctattgtttttttcccaatatttctgctttttgtttttatgttggtttctgtcttccatctttgagacatgttcaaatatctggaaatccttgattgtctcttaaaactgaggcattaaatgcttttggaaattccttgtgcgtatgtagggcttatacttggtgggcttcaatatatggtcattaggcacagatctggctatttcactggtggatcattacatatcattaattgtaggttactatgatctgagtgtgttcttgcaaaatttatacgttgaaatcctcaccctcaaggtgatgacattaggaagtggggcctttggaaggtaattaggtcataaggccaaagccatccagaatgagaatagtacccttacaaaagaggcccaagacagttcccttggacctgctgccttgtgaggttacagtgagaagacaggaaatgagctttcaccagacaccaaacctgccagtgccttgatcttgaacttcccagcctccagaacggtgagaaataaaggtctgttgtttataaggcatccagtctatggtattttgttatagcaataaaacttgactaaaaatagttttcgtattgcaggtaggctctcaggagaataaatttataatctactgcccagaggatagaaacttaagagccaagaaggtgaagagggactgctggtctcaccattaaatatgttgactttaacttaatcctgtattttcagtatggtggctctctcttccatcaactaatcctgttgtccaaatgccaaaagttgtttcagcctcaccagaaagcaaaccactcactcacgtctgctgggatgagagaggagtagtgtctaattaactaccctgagctggggacatgaaatgtaattgccccttttaagggattcaaaacaacccctttatttccagcccctctcgggaatatatggccttctaaaacacctagcgtcttcaatccacaagtttttctgggatcctgaaaaacaaattggcttacttgtcctaattttcatctcattgacttgatatgtctgtgcagatgtctcttcttccattttatttgtcattttatgactgtattgtttttattcccttagcgtaatctttgaacaatttgggagagagagaagataaatgtatgttttcgattgtcatttctattggaggtccatgttcacgtttgtgtcttgttctctctcctcaggtatcctcatctagcatttagtagttgcatgtgcatcgcgtcccgtggtctccagccacccctttaaggtttaaagttcttgcactgcaatgttactggggataatttcaatccattcatcaagcaagagaacagatgcaacacagttcccagcagcaaggctatgtctttattcttacacctacataggcccataagtttaggcaagccatagcgtcaggctacagcctgaagaagcactttttccccaggttttctttcacgaatgcaagcaccacagcccagcctctggttttgaatactgagtttgtctccagttccacaccttgcttgaagcaattttaatcccaactatcccgcagcatccaaattcctggcttccactgttgttttgtggttcagtgtcaagtctgtcagggacttccgccccattctctgctttacatttctgtaaatatatttctgtaaatacacatcatgatttgatatgtatttgattatcttgtcatcaacatatatttctgtaaatacagttctgtaaatatatccttttttattttctattttttcattgctgtattttgggagcagatgaggataacacttggattagaaatctctaatcattttgcattggtttttataataggtaccagcataacgtatatttttccataaggcatatacccaatagagggaccactattttatagccttaagtggaagctctgttatgagacatatgtgtctcaacccagccggttctatacagtttacaagaccaggtagatcatcatgctccccagagagacccaagataagatgattagggttatttttctagcacataaaatagacttccttttctgacatggaggcctgaatcctaaccaaatttccttggtaactgcaacaagaactgtctacatattgttccaattccaccttcagtccttcagggaacagtgtctggtgtgtggcctatgtaacattacacagcactctggagattccacagatctgcaggcctagtaacaaaaatagaagttcaactaaccaatcaaccaacaaggatcactctgggccacctaagtcctgttacagaagacaaagtaatgatcagtctcatcactcccctcctttaaacttcagtgtccttggtactaataacactcatgttggaaataaagccaatagaatcattctgcatatgctttattacctgaaataccacctttaacattaccctctgatgactttttaacagttaacttcaatgtctagcacgttgctatatgtctattttttttcaataatggaagcactagaagggaaatggcattattatgtacacgaaagatttatatacaaagagtatgtaacttattttatttgttaatacttttgctacttttccaaataagaaaaggtaaaacatgcaccctataaaatcacatggaacattttggttaaaaatgcttctgtgtgttctaaaacattataatacttcatttcttgagggttggattctcttatcatcaataataatatcatgtagttagaacgcattggcatagatatataatcattttatgggtccgtgaaatgaggatagaattgggaggtcacaatttttgtagcaatatttttgttattgttagtttttttgtggtactgaaaagaaagcaagcgaagaaagcaaggaaagcaaaggaacgcaaaggaaaaggaaaaggaaaaggaacagaaggaaaggaaaggaagaaggaaggaaggaaggaagaaacaaaagaaaggaaaggaaagcagaagtaaagaaaagaaagaaaaaaagaaaaaccaagcaagcaggcagacaggcagacaggcaggcaagcaagctagttaagtaagattttagataaggaaataaataggaataaataggagatgaaattatatgatcctagggctagggtaaagaaaagagcaaaaaggccataaaatctttctgtagcgtaataataaaaataacttcaaaagtgcttgggttgatgatagcctgacaaggattagcttgggtacataccaattaaagacagctggtctagaagctggtttcacatgatgctacagtaaactggtaaagcaagtattaaaacctaaggaacaaactctcctgtgatatttactggctcaacatcttaaggataaaagacaattatatgatgttaattaagacagtgctatgctggtaaatgtctaacaatcagatcccctgagaggaaggacatatttgaatattcccagtatgtttaattttaagctatcattataatgtcaccaaacatgaagttagcactacaccattatacagtcattccattatacaggtaacaaacccgtagataatagtgaaatataataaaagaattaggtagtgatgacttttgtgcatctagtacatttgtgaacaatatatttcatttaatgtaagttaccataatttaatttttgataatggttgtgtttaacagatctcaaaattcttgaaaatttaacaagtatttccagcacatcgactcaagttaaacattagtttatcacaatgtacacaaaagaagaggttcttatcagtacctatcccatacatcattaatttttcctattcttctcaggtattagtttatataaaattttgttttctctttgaaaataaggagtcttgcatttgtatgaaaattctaacaagaggaacgaacttttttttttttattatactttaagttttagggtacatgtgcacattgtgtaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccaccccacctatgagtgagaatatgcagtgtttggttttttgttcttgcgatagtttactgagaatgacggtttccagtttcatccatgtccctacaaaggacatgaactcatcattttttctggctgcatagtattccatggtgtatatgtgccacattttcttaatccagtctatcattgttggacatttgggttggttccaagtctttgttattgtgaatagtgctgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgacttttgaatgattgccattctaactggtgtgagatgatatctcatagtggttttgatttgcattactctgatggccagtgatggtgaggattttttcatgtgttttttggctgcataaatgtcttcttttgagaagtgtctgttcatgtccttcgctcactttttgatggggttgtttgtttttttcttgtaaatttgtttgagttcattgtagattctggatattagccctttgtcagatgagtaggttgcgaaaattttctcccatgttgtaggttccctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaatgtttaaatctttaatccatcttgaattgatttttgtataaggtgtaaggaagggatccagtttcagctttctacatatggctagccagtcttcccagcaccatttattaaatagggaatcctttccccattgcttgttttcctcaggtttgtcaaagatcagatagttgtaggtatgtggcgttatttctgagggctctgttctgttccattgatctatatctctgttttggtaccagtaccatgctgttttggttactgtagccttgtagtatagtttgaagtcagctagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaatcaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttctgtacattgattttgtatcctgagactttgctgaagttgcttatcagcttaaggagattttgggctgagacgatggggttttctagataaacaatcatgtcgtctgcaaacagggacaatttgacttcctcttttcctaactgaataccttttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgagatatgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccaaggatgaagcccacttgatcatggtggataagctttttgatgtgctgctggattcggtatgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatgtatccatttcttctagattttctagtttatttgtgtagaggtgtttgtagtattctctgacggtagtttgtatttctgtgggatcggtggtgatatcacttctgttaactctacaagtcaaacctgaaatcatggctcacaaccagcaccacctaatgtcaggcattggaattgcatatgtagagcccagaattggttttccacgtacttcagagtcaaatgtgaagctaaatgcacacacacccacacaccctacagatatggccaggacccaccccagaccaaataaccaggatatctaatttatttttatagccatgtaggtaatttaaattcagttgttgaaccaagtttgaaaacgattgtcaaagaaagaggtattactgtaattctgattttaaaattttacatcatgaaaatcttcaaagacatatataagtaaagagaacagtatattatggacccccatgcacctgtcaccaccttgagcaattatcaacatttgcgaatcttgtttaatcttcctccattgctctttatattaaaaataatttccttggaagtttgtcaaaacaaaacccacgaatcacattacttcacctgaaaatactttggcatgtatctagaatttctctttaaatagcacaatctattatagtagcaataaatgccaaaaatcgttaagtatttcttttaaatattgagccagatatgatggtagttgctgcagatgtgaaaaaccttagtgacaattattttttaattttatcttacataaagccagttagattcagagacacatttggtcaaactttgtccttgacatataaatagtgtttctttcctaaactttccattatctggttaatttctcctaaactttccattatctggataatttctcctcattttttagaactcaattcaaggatcatctcacccggatccttccagactgagacccccaaactgtgttagacagtcctgctttggtatatgcctagctcccaaggcagacatgaactgaggactcgtcactgtgcattaaaactgtgagttcataattcctttctgtatatataaatacagaaatcagggtttatatgttattcagttttatatttctagccctcagaatcatagtagggtcacactaatctttgttgaatgaataatgagtctatgaatgaccagtttgacagagtttaagtgtggatgtcaaggataaatgaagaaattagccaagtctgctaatatgaagatgtatatttaaatgagaagattttataatcttacactttcataattatgaccacattgatttgaaggttttatgaagagaaagaggttatactaattatttgagctgtttcttttcataagtgattgtggtcagccaaaattaaacaatgatgctacgaagaaagattaaggaaggatattatcaaacagccccaaacctgccagtccttcatggtttcactgtaaatgctcaggtacagccaatacttatatatgaattttaataatcaatatttaatgaaaatgccgttcttaaatttatctcatatttgtggtagaggagatttacaaaaaaggcattgttaacattagttaaaacacttatacaactgttgttaaataaaacttctgaagtcatatagttatttatttacttgtataaaccatcttatcatattcttttttggagctgtttacatatcttttaatctctgaactaagaaattaaaattgtatttgacaacaattagtgactcaaattataattaaaatatatgttgttacacacctcgacaagcaagcactcagaaacccactttatattctgtttctattaggatactaattatggcactattccaaaaaaaaaaacaaagaaacaaagtaattaactcattgcaaacacaatactattaattttaactccttggttctcaataaaatttgagctagtaaccacgtaattaattattaattgctcagtgcactccactatgccaagttaattatcaagaataacttggtgtgacttttattatgaatggataattacaaccttgtttttctagaattatcaggattttaaacatgaaaataataatgaaggtaaagatataggcattgctcttaaatatgctgatatgctaatcattatgaaataataggatgttcatttttataatagtatcattcttatatagggaccaagacaggatagaaaagtacttagaaagtactaagctaaacaaataagttaacaaaggatgaatcttttatatataatgatatatattcgtgaagtgaaaggccaattcttagttagacattagttttattccagcctaggagaattctcattcattcccatgctctaccataagaattacaaatatctaagtacatgtatgtataaacatttgctgaacctattttggttatgcattaaataatctttaaatgtgaacacaacagtaaaacatatgttttgttttcatcaattttatttcagttactgagtcagaactgcccaactgaataaagttttgtaaacatatagctttatagttccttaaatctaaatctactctaattttcaaagcacaaaaaaatacaaagcttatcaaatatcctactaaaatgttcctttgaatctatggtctcccatttgtttggtgatcaagagctactgttcataatttcaaagaatcttgaaataacaaagtggaaaagtgcttgaggaagagaccaggatacactgacaagtagctcagagtgctaatggcaagggtcagaatcatagctgtattatgcctattttacttatgagaaaattgaggttcagctaaaacttgccaaaaattcacacaatcagagattgatggagccacgattcaaactcaggtcaatctaattccaaagccaagctcttaactgtgtctgagactcacttatccctggaaaagctacaaatctggctttctcctgtcaatattcgacacaaaatgaaggcaacctttatacaagtggcttttatttctttctattcttgtccttggttcaaggatcgaacactcaaggagacctaaatattttggaataggagccaggataacctgtcctcagagatgcttccttggctgcatcacctagccataagtactccctttttgcaggaaaacttgcaaccctagaaccataccataccaaacttccttcattttctgattaaaactattttgtacataatgtcccactttttttgcatcacaaacgccttgaaccattaagtacacaagtatattcctgggaagatgaattaaggtcttcatcttgttcttagaaagtatgtgtttattttctgatagcagaaataataatactttatagttttatagaatcttctcaatggaggatttttaggagcttcacatgtatattactgattgcggagtgtttttattgcatatatctcagtgggagtattggaaatgggtttttcaacatttaaatatatgccatttaaaaaatcccacttcctcttctgcttacaatctattctctgtcttcaaagtgataatattcacttaatgtcgactttggaaacacataataaaaatggtaaatgtggattttcctcactctctttttagctaatattgtggcaaatgtcttcttccctttgtaagcaatattttctctcttttctattaagctttatttgcctagtttagcaggttttatttttctcctgcttatcgtattcctatccatgcgggtcaaaaggaaattaatgagctcttgtttcctctgacacaaaacatttttcttggtacacagttctgcctccccagtgttttcactctggacatgacggaaacagtgaaaagcaataggagatgggagaaggcattgcattcgcaatcaacatatggtcagccacttccaatgagttttcagcactgatgaacactatcactgctgtcttaagcttatgctggtgtccattactgtccactggctgctttgtgaaactacatctcctggctttcttcatacctcgatggtttttgtgctccttttcagggttattccttacccagtcactaaatgcattaaaagtacctcataaaacaggatgacttcatgtcctttgcagggacatggatgaagctggaaaccatcattcttagcaaactaacacaggaacagaaaatgaaacactgcatggactcactcgtaagtgggagtggaacagtgagaacacatggacacagggaggggaacaacacacactggtgcctgttgggggtggggggctagggtagggatagcattaggagaaatacctaatgtagatgacgggttgatgggtgcagcaaaccaccatagcacgtgtatacctatgtaacaaacctgcacgttctgcacctgtatcccagaacgtaaagtataataataattaaaaaaaaaagttcctcaaagatttgtcctgatcaatcttctacctacagtctctctttaggttattgcacccactcacataactttaaatattatttacatgcctaggtatcccacgtatgtatcttggtcacagatatttcatccacgtttcatgtagatgtttcagatgtatctcaaattgaatataaatctagaaaggtctccacctccaaatctgccccttcttttctgttctccagctcaatattatctaatatgctcagggatcatccctgacacttcactgtctttcaactccactttcaaatctgtcaaaagttgctactaatagctccattaacataagtatcaaagacatgtttatttccacttccattgccatctcaaggcttggtctatgctttggtattctaagtggccattctgttttcagggaggttccctaaagtacattgttttcagcaaaaacaatgattatgtcactaccttgctgggtgaggtggctcatatctgtaatcccaccattttaagaggatgaggcgggaggattgcttgggcccagtaatccaagatcagccttagaaacttagaaacgtaacaagaccctgtctcttcaaaataattgtttaaagttagccaggcatagtggcaaatgcctgtagtagtcccagctacccaggaagctgaggtaggagggtgatatgggaggattgcttgagcccaaggagttcaaggctgcagtgagccgtgatcatgtcactgcactccagcctgggcaacagagtgagattgtgtcttgaaataaataaataagtaaaacaaaatttaagaatcaaaaaataaacttgtaatggttttccgttgcacttagataaaatctatacttatttttgtggcctacaatgacttgtacaacgtaaaacttgccacgctctccctctctcaccataccccatacacaagggctttcttttagaatttcgaacattccaagatctctaccaacatctcaagactttgttcatgtgactccctacactctttactgagttgcaggtctctgcttcaatacttttcctcacagataattactctcagtctctagactgcagcatttctttttgttagaatatctcatagctccttatacttttcattcatagcacctactgcggcttgtaaatatacactcatgtatatgattattgccttaaaatacattttcccccactaaacattcagctccaaaaaggcagaaacaatgtgttctttgttaatttctgtagagtttttgagacaggatcagaattactatatgttgaataaatgaatacagaaataaaaataaagattatgatgcctttgctcactgatatatagtgccatatatatatatatataaacatatataaataaatatataaatatgtgtatatataaatatatataaatacaaatatataaatatatatatataaatatataaatatatatataaatatatataaatatataaatatatataaatatataaatatatatataaatatatataaatatataaatatatataaatatatataaatatatataaatatatatataaatatatataagtatataaatatatataaatatatataaatatataaatatatataaatatataaatatataaaaatatatataaatatatataaatatatacataaatatatatagatatataaatatatatatacataaatatatataaatatatatatgtttgtgtgtgtatatatatttatattcaacggtaaatggtttataaaactttcccgatcgattaagtattggtatggagtcagagaagtgagggaaaacagttttatctaccatctttgagatatcatggtgagatttaaggatacagagattaaatatattgtccaggtctttaagaacctcatagacagagtttatgtgtgactctaaaaaatagatgaagataagaagataagtatttaaatgaaaaaattgaggcggccaagggtttggggagcttatgactgtctttaaccctatcgacactaagagaatagaagttgcttactaactggtcacttagctgactgaaacagcttctctctttgtaggaagtttaagttccacaattactcggtgccaaaaaatactgtgtgctattcaaatttctggaggatgaaaagctacatagggcatatggcagaacgatgtaaagtgcagaatatgcttagctgaagattgtcccaaagctcttgggagatgtttatttggtgacaatcgcattcactttatattgtcagccctttgttagatcatccttactcatcagggtctgatccttgctttaattgtacttagggaattatttatctctatatcaatctaaaattgatttaatcttttttttttttttttgagatgtagtctcgctctgtcacccaggctggagtgcagtggcgtgatcttggctcactgcaacctccgcctgctgggttcaggagattcttctgcctcagcctcccaagtagctgggactataggcgtgcaccaccaagcccggctaatttttgtatttttagtagagacagggtttcaccatattggctaggctgttttcgaactcctgacctcataatctgcccgtctcagcctcccaaagtgctgcgattacaggcgtgagccaccacgcctggtcaattgattttgtcttacacaattttctcttctgggcatcactatcgttcatcctcatcttctttttcctctatgtttaaaaatgaaaactcttctgcaaaagagtttattaaagcttatttattctttgtttgtttttgagacagagtcttgctctgttgcccaggctggagggcagtggcatgatcttagctcactgcaacctccgcctcctgggttccagtgattctcctgcctcagcctcccaagtagctgggattacaagcatgcgccaacacgcctggccaatttttgtatttttagcagagatggggtttcaccatgttggctgggctggactctaactcctggcctcaagtgatctgcccacctcggcctctcaaattgctgggattacaggcgagagccaccacacctggcctattcttttttgttttatataagaagtgtagcatataataatgtgtggtggtgtggtagagataagaagtggtttttgaaaaggaaaatgatcacatatacattattcacttgctagttatgcttactgggtatctacttggccaaacaatgaatcaagtaacgaaaatgtaactgtcattctaaagaagttcacagtgtgtatgttgtttgtacatgtacagagtcatagaggtgagagagatggagaaaagtgatttaataagtaagtacacaaataacaaataacatgattcataatgtgaagggtgtttatatccacaatggaaatggaaattggtgagtaccaatttttattagatgttacccaccattgcattacatgcaattgttccatcttaaccatatcagctgcactaaacatggctcattactgctcactaataggaatacagatttatatcagcaatttgggcacatgggcttgtcttttttaactgtgggaaaatatacaaaatatttcaaccattgtaagtgtatacagttcagtggcattagatacattcacatggatatgtaaacatcaccaccatctatctccaaaactcttcatctttctaaactgaaactctataccaatgacacaagaactgctcatttcccctacccctccctggtccctggcaaccatgcaactatttgtctaagaatttaactactctaggtggaatatctccaaagttcatccctattttaggatgtgacagaatttcattcctttttaaagcagaatactgttctgctgtatggatacaccacgttttgtttctccattcttggtcagtgtacacagtgtacatttgtttctaccttttctctacagtaaaatatgctgctatgaacttgggtgtacaaatatctgtgtgaatacctgttttcaattattttgggtatatacccagaagtggaattattggatcatataatagttctttgttaaattttattttaagaactagtcttgtagtttaaaaataaagttttattggaatataatcacactcattcatttacatattgtctatggttgcttttgcaaaaaaaaaaaaaaatggcagagtttaatagttgtgagatagaccatatggcccgcaaagcctataatatttactatcttgttccttacagaataagtttgctaacttctgtcttacaaaattgcagtagcaattccttggtttcacatgaaacatatgtcttcaaacagttaaaagacctttcatgttgggaaatagaaacaggataattttattctcggcctacatatgagaaaacaaggaaagtgctgaatgccacatggaagttgcaatctcaaaggaagttaatccaatattaatatccagacctcattgttgcagctaaatctatctcatcacaaatcacagagttattttacttctttatatgctatatagaaaactcagatatactttccctatatcaatgcgatgtttcatgctttcttcttttattgaagatggggtgggaatactgcatcaagtgagagacttgagtctgggagaggctgagttgtataactgtgaaatcatttgtcctccaaaagcttggatttaaaatataacagattcacgtactatgtatgactgaaaacatacttgcctggaatgttaaagatcagggtaattttctgtctcgttaatctaatattgacagtggagtataaaagtctctcactattactgtgtaggagtgtaagtctctttgtaggtctctaggaacttgctttacgaatctgggtgctcctgtattgggtgcatatatatttagaatagttagttcttcttgttgcgttgctccctttaccattatgtaatgtaatacccttctttgtctttcttgatctttgttggtttaaagtctgttttatcagagactaggattgtaacccctgtttttttttttattttttttaattttttatttttttgctttccatttgcttggaaaatattccgccatccctttgctttgagcctatgtgtgtgtttgcatgtgagatgggtctcctgaatacaccacactgatggtcctgactctttatccaatttgccagtctgtgtcttttaattggggcatttagcccatttacatttaaagttaatattgtcatgtgtgaatgtgatcctgtaattatgatgttggttagttattttgcctgttagttgaggcagtttcttcatagggtcgatggtctttacaatttggtatgtttctctcagtggctggtaccggtttttcctttccatgtttagtgattccttcaggagctcttgtaagccaggcctggtggtgacaaaatcactcagcatttgcttgtctgtaaaggattttatttctcctttgcttatgaaacttagtttggctggatatgaaattctgggttgaaaattcccttattgaagagtgttgaatattggcacccactctcttctagcttgtagggtttctgcagagtgatccactgttagtctgatgggcttccctttgtgggtaacccagcctttctctctggctgcccctaacattacgagcaacttcagccaagtctcagaatacaaaatcaaagtgaaaagatcacaagcattcctatacaccaagaatagacaaacagagagccaaatcgtgggtgaactcctattcacaattgctacaaagagaataaagtgcctaggaatacaacttacaagggatgtgaaggacctcttcaaggagaactacaaaccactgttcaagaaaatacgaaaggacgcaaacaaatggaaaaaacatttcatgctcgtggttaggaagaatcagtggagtgaaaatggccatactgtccaaattaatttacagattcaatgctatccccaacaggctaccactgactttctttacagaattaggaaaaattactttacatttcagatggaaccaaaaaagagcttgtatagccaagacaatcctaagtaaaatgaacaaagctggaggcatcatgctacctgacttcaaactatactacaaggctacagtaagcaaaacagactggtactggtagcaaaacagatatatagaccaatggaacagaacagaggccagaaaaataatgccacacatctacaaccatctgatctttgacaaacctgacaaaaacaagcaacggggaaaggattccctatttaataaatggtgttgggaaaactggctagtcatatgcagaaaacggaaactggaccccttccttaccccttatacaaaaatcaactcaagatgcattaaagacttaaacctaaaaccgaaaaccatcaaaaccctagaagaaaacctaggcaataccattcaggacacaagtacggggaaagactgcatgactaaaacaccaaaagcaacagcaacaaaagccaaaattgacaaatgggatctaatgaaactaaagagcttctacactgcaaaagaaactatcatgagagtgaacaggcaaactacagattgggagaaaatttttgcaatctatacatctgacaaagggctaatacccggaatctataaggaacttaaacaaatttacaagaaaaaaaaaaacccatcagaaagtgggctaaggatatgaacagacacttctcaaaacaagacatttatgcagccagcaaacatatcaaaaaaagctcattatcactggtcattagaggaatgcaaatcaaaaccacaatgagataccatctcacaccagttagaatggcgaacattcaaaagtcaggcaacaacagatgctggagaggatgtggagaaaaaggaacgcttttacactgttggtgggactgtaaactagttcaaccattgtggaagacagtgtggcgattcctcaaggatacagaaccagaaataccatttgacccagcaatcccattactgcatatatacccaaagtattataaatcattctcctataaagacacatgcacacgtatgtttattgcagcactatttacaatagcaaagacttggaaccaacccaaatgcccatcaatgatagactggataaagaaaattggcacatatacaccatggaatactatgcagccataaaaaagaatgagttcatgtcctttgcacggacatggatgaagctggaaaccatcattctcagcaaactaacacaggaacagaaaaccaaacaccacatattctcacccataagtgggagttgaacgatgagaacacatagacacagggcggggaacatcacacaccggggcctctcaggggatggggggttaggggagggatagcattaggagaaatacctaatgtagatgatgggttgatgtgtgcagcaaaccaccatggaacgtgtacacctatgcaacaaacctgcccgttctgcacgtgtgtcccagaacttaaagtataataatgaaaaaaagatcagggtaaaatatattttgtcattgttttgaacatagccataggtaggatcataaaatagcacaacttaaatagaaaaataaatgattcagaatcaggtctcaggtacaaacagccaaaataattcaatgaaattatttctctatactacaaattgtggactcacatggcatcatatctgatataaataatagtttattttaaatgaatatagacaggagtggctggaaactaaaagcatgtatttcttctccataagatgaaagaggatttaggatacacttaagataacatactaaatcttgttttgccagtgtagcttctgcttggcatttaaatatctgttacttaatagaaacattcaattttggaccctaaaatatcacacaatattattcattaaaattatacctactcaaatctgtctagccatatcatatagcgactgatatttttagatcaaacccacaagtgtgaaatatttttcattttaaagactcttttacatttaatatgtattcatgctaactttttaaatttaaagcaccttctatgaaatgtattttaatacaaataccctatattgtataatttacttcaacgttgtaaattttccacgacgatgtgtatcattcacaaataatatgaaatataaaaattcacttaaacatatataaaattattggtatatttactttgtactaaatgtaatgggatttgatattattatattaaatttatattcatgatgaatataagtaaacattgagtaagaaatgttttaagaaatttgctatctgcatgaatgactattcaatacatttttattgaacatccatcgagttcgttgcgatgaatacagttttagaaaaaatactaatactctggcttcgaagactgctatgtattgaaggtctacaatgctttgaatgctgtaggaagacaagataaattaggacttttgatcaccgtcccataaaagcttataatttgtctaataaggaatagccaacaattattacaataggagacagtaaaaataagtagaatgcaatgttccagatgttcagaggagttggagatcatctccttatgggttggtcaagagagccttaatggaaaatgtagcatctgagcagggcatggaaggatcatttagtggatattcctctgtcccaaaattttttgtctgtccaatatcccttctgtggtgaagaaaattagtactctttggatatcttggtattgatttcattatgtttctcatgttcccttgaggtttcgtgagtgcaattgtgattgaatcctggaaagtgggaaagtgtaggaagtgatgcatcacttcttgcctgaggtacttgatagttagtgtcaatttctcagctctcctttgtcaatacctctgaagtttcaatgttgacatggcagagccacaagatgaaagcaatttaggtccctgagtcactgtgaaggaatgctacctgatttatatcagactttatatgagcaataaataagcattcattaggccactttgatttcagggttagtttttttgtggcatctaacattaattgttctgaataagtatctccactctttggtgaatggtaccctgcttttccttggatgaaattactcttccctcattctgcatgatcttagggggacctataatcatagtgctctgtaaactctataaactggtgggacaagttcctaatttatgccaattacatttagaaatttgaatctagaattgagaaaggtagagtcagtacaatttgaagctgaagcattttaatgacagcatccaaaaagtaacttccctggagttcctgactctcagtgctgccctccctctgccacagttgccttcttttccttcatttccaagaactatacattatccctccagtaagtttcatttcacttcagttaaatggagatggcttctgcttcttcgaatcaaagcttcctaatgtttacaggtggtgaggacttttatatataaaattacactccaaagaagtatggaataagggtattttagagaaaataagtacattttgctgtagagttgcatagagatacaagtgacagaagctaagttagggtttataagtgccagactatgaattctggatgttagcctctggcctaggaggttagaaaatcaaatgccttcaggggacacgtgggacacataaaattgtaaagccttagaaagtatagcaataagtgctaaactgatggtgttgatcagtccagtctctgcccggtttcattgccttttaatgttccttgcaggtcaaacaaagcagccaagcaaaacatatccttcagctctcttttctcctggggctacccgtttgaaatcaaagctatcaacagagaaacactgaaggttcctgtgctgggaaatgtgaagcaggagtgctgcttcagaaaggttaactctttcaaaagaaacagtgatttgggtggagagagatctcttacaaggtatctactgacttgcgattgatgtccaggagaatgaaaagggagggcatgaaaacataaaaagtgtacagaatccagtaaatggcaaaatattcaattaaagtgcagggaggtataaagaaaggacaacacatgttttaatctgaggacattataagaaataatggtggtatgttcttggaattgagaagcctaactaagtcacaggttataggaatcaaagtggtggtgctattgacttggtaaatttaagagaactttataaaatttgtgaattcgttatttctttatcttaaatgcaatagcactaatgcctcaaaagaacaacctacaaatgtctacccacagaagttatacaggctattttgtttcaatgaatggctggcccgagaaaatggttgcactcaagagagaatgtttgcgactgtttttggaaattcttctgtgggttgggtaataatacactcaagagacatgtttgtgatttttctgggaaattttttcgtggagtgggtaataaatagagcagaatattaggtgagaaatactcaatttcaggactagttattttaaactgttgtaaattataatattaaattataaaatttaaacattgtgaatatgttctttttctgtactcaggtattaaatcaaatatttttgggtaattagtggaaggtgagcttataaaaagattgatagcaaataaaacagtaactgcctcaactccagggttacttgatacctaagggctaatccaaacatgatagtatctttaaatacataatgtagacccataaactagtatcggaatcaaattacaatgtttttattgactttcttaatgtgtgtaatcacacggagatcatattattcacaaaatgaaagttagtagtttgtgagtgaaagaaggcagaccagaaataaggtacatacttcatgattctacttttataaaattctataaaacgcaaacttatctataatgccagtcagcatcagtggtaacctgggaatcaagggaggggcaggagagagtgattaccgaaaacagacttgtgaggatattggatatgtttattatcttgactgtgctaatagtttcactggtatttgcatatgtcaaaacttatcaaattgtactatttaaatgtgtagcttattgtatatcatttataccacaatgaaattgtttccaaaaaggactagcttggccaatacactacctaaatgcattactaggtatacaagttttacttaaaaacaatatatgtctcaataagtataaagattaccgtagcgaacactgtggtgtgccaccgagattcaccaattacaaatgaagcattcattctcccagttgctgggattgttatctactaacagatcatacctaagctcttccaagaaatttctctcagcagacaggcacttctttgaccaagatgatattgcccggaagctggtagttgggaggctcacatctaatgactaatggattagggatacaatggtccaccttccttgcttcatacggtaatactctaaatggtcatcccaaccccacatgggaccagataagatcttccatttcactgcatcatcattcaactcctctctctcctcaatcctgctgcctttactccctcccaggcatttttcttaaaagcactcactaagaaaccatctgcatggaaatctctgtcttagagtctatgtcttagaaaatccaatctaagataacaacctaatatgttgagaagttaaaatgtagaaaacagaaatacatatctgaagtaatcatttaaataacattatgaaaatgtacatcagtatttataaatagccattatatacaatgatacaattttgtttatcatttcttcaacttactgctagatttcagggaaaaatacaggatacaagtacttaaagaaagctcaagaaggagatatggctgattgcataatagaatattttgcagactgtcaactattgaggacgctggcatgtttggaagaataactgttattaaattttagaacataaaggtacaacatattgttatcaatcttaataaatccattcagcatttcagaataacatgaaaatatgccaacagaaattccattttactattgttactatcaagaacttggcaaaatttggttttttactttgtgaatgtattaaatgatacaggtaacatatatggaattaactatatgctaactgtagcaggtttcacttttcaataaacgaaatagccgtgacaattctgtctttaggatgaagagagagcattttccatgaaaatctgaattgattttcactatctaaagacatgaaacacatatgctagctctggacgacaaaagaagatgaaaatgtcctctataggaaggccatccaggatgttgaatggtaagagacaacttccatctaattatagacacattaaaacatggtccgttaactacaacccttatcctttccctttctaccaaccctcatttatccctcagccattgattttaaaaaatattttatatatttgacacccaaaggaaaaaatgtaaatgaaactcacttccaagagactactgctctcagcaaaccaaaaagagaataaaaaacaaatgtctacaaatttcttcaatgtagaaaaacaattcatagatcttaaaggcagtgatagggtttggctgtgtccccacccaaatcccgtcttgaattgcagttcccataatccccagatgtcatgggagggatccagtgggaggtaactgaatcatggggggtggtcactcccgtgctgctgttcttatgatagtgagctctcatgagagctgatggtttcataaggggcttttcctcctttgctcggcacttctccttcttgccatcatgtgacaaaggatgtgtttgcttctgcttccacagtgattgtaagtttcctgaggcctccccagccatgcaaaccagtgagtcaattaaacctcgttcctttataaattacccagtctcaggtagttctttatagcagcatgagaacagactaatacagtaaattggtaccacagagagtgggatactgctataaagaaacccaaaaatgtggaagcaactttggaactgggtaacaggcagaggttgaaacagttgggaggactcagaagaagacaggaaagtatgggaaactctggaacttcctagagaattggaggggtcagaagacaggaagatgtgggaaagtttggaacttcctagagacttgttgaatggctttgacccaaatgctgatagtgatatggacaataaagtccagactgaggtggtctcagagggagatgagaaacttcttggtaactgtagtaaaggtcacttttgctacgctttagcaaagagactggtggctttttgcccctgtccgagagatctgtggaattttgaacatgagagagatgatttagggcatctggtggaaggaatttctaaacagcaaagtgttcaagatttgacttgggtgctgttaaaagcattcagttttatgtatccacaaagatatggtttggaattggaaattatgtttaaaagggaagcagagcataaaagttcagaaaatttgcagcctgaagatgcaatagaaaagaaaaactcattttctgaggagaaattcaatctgactacagaaatttgcatatgtaacgaggagccaaatgttaatcaccaaggcaatgggaaaattgtctccaggaaatgccagaagttttcatggcagcccctcccatcataggaccagaggcctaggaaggcaaaatggtttcctgggccgggcccagagcccccctgctatgtgcagcctagggactaggtgccctgcatcccagccactccagccatggctaaaaggagccaagatagagctcagcccatggctacagagggtgcaagccccaagatttggcagcttccatgtggtgttgagcctgtgggtacacagaagtcaagaactgagctttgggaacttctacctagatttcagaggatatatggaaatgtctagatatccaggcagaagtttgctgcagagatggggccctcagagagaacctctactaggtcagtgcagaagagaaatgtggggttggagcccccacatagagtccccactggggcactgcctagtagagctgtgagaagagggcttgatccaccgtgtgcatggaacagccacagacactcaatgctagcctgtgaaagcagccaggaagggggctgtaccctgcaacgccaaaggagtggagctacccaaggctgtgggagcccaccttgcatcagcgtgacctggatgtgagacacagagtcaaaggagattatcttggagctttaagatttaattactgcctcattggatttgacatgcatggagcctggagcccctttgtttgggccaatttctcccatctggaatgggtgtatttaaccaatgctggtacctccattgtacctagaaagtaactaacttgcttttgattttatggctcctaggcagaagtgacttgccttgtctcagatgagactttggacttggactcctgggttaatgctagagtgagttaagactttgagtgactgttgggaaggcattattgtgttttgaaatgtgaagacgtgccatttgggaggggccagggatgaaatgatatggtttggctatgtccccacccaaatctcattctgaattgtagttcctgtaatccccatgtgtcatgtgagggacccagttggaggtaattgaattacaggggcggttatccccatggtgctgttcttgtgatagtgagttctcatgagatccaatggttttataaggggcttttccccctttgctcagcacttctcctttctgccaccatatgaagaaggatgtgattgcttccccttctggcatggttgtaagttttccctgaggcctccccagccatgtggaactgtgagtcaattaaacctctgtcctttataaattattcagtcttgggcagttctttagagcagcatgagaacagactaatacagactgtatgatcaatatattttactttctgagtttacttattaatgctaaactgtatttttacctttttacttttgaacgccattgtcatattaataagagaatttttttgaccaaagcattttaagttctgtacacttgcagtatttgatctacagatttacacatcatggacagaaatgttatgaaaatcatttacagaattatttaatggaaaacgtttcatatttaatatattttcatatgttgtacatgtaagaaatctgattttatggccattgataagagcgataatggcagccttcatataagatacatttctgtctttttatttttgattatacctgcaagaagacacatggtcctatgcagccaataaatagttgtataataataaagttatgataataaatgtttatacctttcatgttttacatacaccaccaaatgcaaaggaactatgaagcagtttgcactgagaccagttaaaacctaaattctcccctttagctatgcggtgatctatttcctgctacatacaaaatcctgaaaaaatggggctggaagtaattccagtgcttttaaacccaatctacaatttaatttcctttgtgacctttgaaacatcactgttatagaagttccaccattcctaatgccccagatttgccactgttgtttccttattaagaagcaaaacaaagtaaaacaaaaaccttcacataattttgagttctctttcttctcagtaagggaaggattttcacttaacttcacttatctcatttttctgtgttcttcaaccttaaactacatccagccttgttcatgtctctcttaaactttcttctttatacatttcaaaagctttgctctttttctgtcatctaattgggctagatctctattcatattactctttatgttacaacctattaaccaaaatattttcatgtggcaaagaattctgatcatgaggcaaaatgaactaatgagaaaaatttgtcttcatttctagtgaaaactaatttattcttgctttctctagggatatttcaagaattgtacttttggtcttttaggactttgaaaatgttggaattggtagtgaatttctaaccaaaactgtgcataaagtcagctgcttcaaagcaagtcatagaagcctccagcaattctgtgaccaaagaaaagtaaccctaatattaacctttcctttgactttaaagacaataatttgaataatttccaggagacttgaaaaaatcttcacacaaaaataaagttttgttaaatcaatactttgagaaatacccccaaattatttctatattggtgatagtaaaagacaaattcaagtattttatgtcgttcaagaaattggcttgtgtaggattgtgcacgtgacctttaatttccacttctaattttgtcactaactgttatgaatcacacttaaaaaacaaaccatggctatgatctttttaaagctgtaaagcaagactcaataattcacagagctaaccaaaggtgagtacataggaatatcaaaggtatacattagcaaaagattaaacaagtaagtcaataaggaagaaatagaaagacacagccacacaagcctcagaatacaaaagctgatggtgaatcaggatccagaggaatgcaggagtcagaaaagtaacacaaatacgcagaagagtgaccagctggatagggaagtgcagtggcccttgctagggtaataatgcccctccctcacattgccacagatccaggtggagctcacccattatcttgggcctggacactccagggtactctggttgatgtcctacagccggaaactgcatgtcttagcctaaagtctatctttgacgcagaaaaagtagctacaaccacatgcaaaaacaggttggaagtagttgcaagaggaaattaataccctgacaccctgagcggccctttaaaagtgactaacaagagttgaaatataaacacctcagctcctgcaccttgtctaagataactctgagacaagtgttttatgccttcccagactttctccagggaattaagccctagttctcacagtggtgtttggcttgataacatactctttacaggttgctttctcttaactttctcacaactccaacatcctaccacagcttcctagaatcactgcccaaagaaactatttgaactcacatccttgtctcaggatttgcttatgtaagaacccaaactgagacactcataatgcaagaatttatattattaataccagaatcaatccttaagcatggctagtttgacactctacatagaggtaaggaaaagcacttaactggagcagaaaattcactcattcttttgaaaaatgaataaggtactcttttttgtaatagagagtgagtgtaatgggatacagacatacctaatagtagtgttacagtagatagctagtcagatatgagcagggtaggagaccccccacccccgccaccccaaccaggaatgtcaggcaaccatcaagtgatggtcagtcaggtggttattaaactgtgtctttaaaataataattggtcacagccaataccagggaaaggcagtctcccaatagataaaaacacctgaaattggtgatcagcagcttcccgataagatcgcaggagttgggcaaatgggctcccgcgtgcgcactaagaggcaaaatgtcatagtgtaactggtatacgaccttcctctggaaacacttgactggtaagggaacacctcttgaatacaactccagtaaatacaccgtgcatgctcccctcccaagtgtcagcagaccactgtgcatgcagatagccccctaccccaagggaagaattggggagaaggtatataagaccatggaagtatgccaaaatacaaaaccataaatcaaagttcaaacaggacacttaatatctcaagtcgcccacttggcccccttccagatgtactttatttcctttcatttctgctctaaagtttttaaataaactttcattcctgctctaacacttgcctcagtctcttcttctgccttatgcctccttggtcgaattctttcttctgaggaggcatgaattaaggttgctgaagacccgtatggattcactgccagtaacaggaggagagagagttattcaacgaattattatataccgactatatagtaagtgaccttactcattccggctcaccatcacaatatgagtattagggttcaaaggacaagcttttatgaaatgtaaatctcttaatataaagaattaaaataatatccaagtattagattctaaataaatacttttaaaactagttattacaagactgtatctaatcacaaacaggtttttattttgttttgtttttctcactatctcaagctgctgaaacaaatttaatggagtccttccctcatcactgaattctgtagatttttctttcagttgtaagaaaataatgctttccttttgaagatgttggcttggattagaaaaatgctttattatgagtattgcaaagctacttatttaccacagctagacagagactctttcttactttgtcatgcagctgcttgtttttaaacaaattttgccaagagacataaaccagatggtcttcttcaagggtatcctgtgagctgtgatagtcagcttatggtagttttgagcagcagacagctgggtatggaaagtcatgatgctatttggaaatccaactaccaagtgtgctgaagcacaaggagattctcaagtcagtaaataataaaattgtgacttaaagtttgtttcagtattctatttttacagggggcattaactttatgctttataatattacttttctgggtaaaataaaagtaccccaacacattgaattagaaagaaaacttgtgaaaaaatggattcagaatacctttccaagtgggatcaacaaattgtaagttgggctttctaacagagttgtctgtgttttatcaaaaatgtttaattaatactgtaataaaattctactagaatggtgtggtatttcaagttgcaagtctcagttctgttttgtagtagtgttatacacccacactcttgaaatgggttcactaactgccaagtgtatttctctatccctgatctttggatatgccacgtgacttgctttgacaattgactatggatggaagagagaacgctagttataaatctgggtcttaagaaccatcatgtgtttctgcttacccttctgagatctttagaactcagccatggaggaatgtgccccaaatatctactgccattccagcttgagccccagaatgagacacatagatcagacatgtttggtcaacctacagtcagattctgaatcagagattactcaaagtaggcctgtgaatatgaggataagtgcttattgttcttttggggtatgcttgtcacacagcattattgtggttgtagctgactaatattgattgactttggtgagggcccaataaacagctaccttgggtcactcctacattactgagagataggggaaagaaaatgagataaaaataaaagttagcatctacgtccttatcaggatgctactattttatggaaggtacccaaagaaattccagaattatatctctgatgattccaaaattccttcaaaacaaaggacacagactggaccatccttggttttcaagtactatgctataattttgaatattacagaaagacaagtgaaagaactgaagaagaaactaaaaaagcatttcaagacaaacagacaaaatttgcctttttatgaacaaagatagtttaaatttattcaaacatataaattactcaaaggctaagaattttcaaatgtgcatctaaattgtcatttcctacaagtatctagccatactaggaaactacaaagaatattttaaaacttgtatttcaggcagaaatctctcaaaaaaccacatctgtggcttgtaatgggcagttttcccttgagaacactgatattttcaagaggaatttgagactatccacggataaactaaaactaatatgaaaataattcttgtgaaaattgccttacaggcaagaatttgcaactttcatagggtaaacagatttttaaagcgttagaatttcataattgtgacaaacatcctcctagaatagaaggtgaaacaagcaagtaagcagacaagcaagcaagcaaacctttcaccagaatgttatactgactttagtgactaatggatatatttttctctatgagagactgttcatgtatctccaattccctaattagaaaaacatatatccaggtcttagattattttatatattgctgtatccacacctaaaagtcatgatttgaccttagtatagcgaaatgaaaggaaatataaggaaatttaccctgcattaataatttattgaatacactatgatggaaatggagattctgttaaccaaagagtttctcaagaaacttattcattctagaatattacagcttttgagtgagaagcttattatatacatttaagggctcatcaataaaatattaacatgtattgaacatctaacatgaaaccatactgcattccacttaggggtgacaaaaggtatatagtacagcctcttccctgtaggaaaaagtactccactgaatggtaacatgttgcaaacagctatgtaagacatataaactcatgataataacctgtaagataaataggtaaacagagagttctatgaatccagacaatggaataattgatcaagaacagagaaggattccaagaggtggtatttgcactgaatgctgaatggtgtgtaggaatttgctaaggagcaagtcaggactcctcaagcacatcagaaaatcctttaccacttggctttgctaagcatcttgtaatgaattacaatccatttctgctactgatctcgaacataaagatatcaccttcaaaaatttaaacatctttttaaagtactttggtcttgtatatgagactttaaaaagtcattatacgtatttgtgttgtttctactgatgtctatagatctggaaggaagaacataatccttgagcataagaaatcctatgtgaaatgccatggaggcaggctatgtagtggaaaagaattcataactggggtcacgatatagactctggcacatacttcatgtgtgagcttaagacaattatttattctaaaactcaaaattattcgtctctaaaattaaggttctcttgagaatgaaatgatatatgtaaggctctgaacccatgcctggcacataggtgtgcctaaaaataagctcttttatcttatgcaaggtccatcctacgtgtccagaaaaagtaatgtcttgaaatttcagtacattgtcataatatcagctttaaacttaggtccttgttttatagtggttagtcagtgaattagtaagcaaaacttgctaattaaatttaggtaacttatataacttaggatccaactttagtaaaatttaggaaagcattagccctctaagtaggagcgctatgacaaccaaattctccatttctcacatttcctaagcagtagcttaaatctaagtcagacaaaagttgatgaatgagaaattactttgagaatatggagaaacagaagagtaggtacctagggaaatgatgaaaacttctactcttatattggcagaatttagtaagccagagtaagatgcgggctgaatcagagttcataaaattaggaaagaaaaaaaaagggaagggttaactaaagacaaagttgccctttttacactcttcttagggctccttaaataaaacaaaacaaaacaaaacaaaacaggagccgggtgcagtggtgtgcctctgtaatcccatcttctcagaaggctgaggtgggaggattacttcatccagggagtttgagaccagccccagcaacactctcactcaaaaaaaaataaataagtaaaagaaaaataacgctctttttaaatatacatgttgaagactgttagttctcttccaatattctttttttttttttcatgactgaacagtttttagcagagcacatgtgaaataaacacatttcccagccccacttgcagcttagatgtggccatgtgacagacatctggccaatgaagcgtaagtggaaatataacatggcagctcccacgaaacttccctaaaagacaattggtatgcaccctttgacccttcttctggccttcttacatccttcttggaatgtggatgtcatgagagctccatcttgcaacatgtggatgaaattccaccaagtaaagataactcactcagtagaaaacagaaatgagcggggccaacatatctgccttggctgcaaacttccagggtttttcaggagaaagaaataggcttctcttttatttaagtcatttctaccttgagcttctgtaacacttagccaaagcaaattataattgataaaataaagagagtttctgggaaaagtacatttagcacagttttattttacagtaatgtcttttaaaactcatctattccaggtagagaaaaaatgcatatttagagaagggaaatttgtgaaatgacaaaaccaagaaatacacaatgaataaagtcaaatattaatatcagcctccaaaatgaggctagtcctatggacacaaaatttctttctgtattagagtctttttcctttgacaataataaaaatgtttatttagataacaagcaggcaaatacagtcccctcatatactgaagaacaagaatcatctatggtgaggatgaaaatgcttgtatacaactatcctgggaaacaaaaatgttcaattactttgagaaaaagactggggatattgatctatggctaactctgagattatgtgaattttatatctagtcaatttcttatctgaagaaagttttaaactaacctctaagtgaactgtgaagatttataagaatctgaaaatgttgaagatataaggcaaatgatcctggatgaagcggtgatcataaaaagcaaatcactctgcaactcttaagtgctttgaactataaataggaatatgcagaagataagctgatgggcagaaacaaacttctatttaatgcatttcaaaaagctctttcacttaataaatacaacaaattttcttctttaaattctttcaccacctgctcttaacaactaagaattcagaagaaattatatttaaaactaaacaaggaaatgtaaatgaaggctagtttagatatctaatttagacggtatagtgtgctgaatggttcatgttttttaaagagtttcaataagtcacaataagataagaatattattcattgataattggtttgttgtaaggagacgctttgatagtccaatatacattaaatacctcatgacaccaactatatggggttaatcttttgcagtttaaagctttgcctctggtagtaaaacttccatgtaattggcatcaatagtcaaatcacacaattcattttgggttgctgggtggaaacaaaatctcctctatttggctcacaatcactctctcagtggtgtgcaaaatgcaatgactggccagtgaatgatatttacaatagctagggattatcttagattatacagccttcagcagaaacataaacacttgaacagagcagtgtgaaatagaagatagtgtgtgggaggaggcaagctctaatctgaaatatacaagaagaaacttacatatggcaaaaaagacagtatatagaggctacgcttgatggagggagattataataaatgacagattaatgagacttgtttttctcgaagtttatgatggtttatttctggcatacatgccaagttgatgctatcaaattatagtgttcattaccattattatcatcaagtcgtattgattaccaatgtgcactctactgggcattatatatacaagcaaaattcaggtggtttctgacattcaacaaccaataaaataaatcagaccaaagattgtagacatatgtaggagagcgtatagtgcacaagatactcaaatggagaaaaacttaaaggttaaaaataaatttttaaatactttcagtgtttaggtgaactggtaagtgttttggtgtgtcagtttataagaacattgcttgctatatctaagggaactacttattcattattttcttaaaaatgaattctatccaactagttacttagtaaatcatgattttcaaagaagatcttgagggtaaaaaccagaacagaacatttccccataaaccatggtttcaacaattcaaaaaagtgagacggagtggtgcaagatgtcagaatagaagcctatataactaatctccctcactgaaacatcaaattgtaacaactatgagcagacagaaaagcactgtcaccagaaccaaaaaccaggtacggaatcatggtacctggttttaacttcatcttgctaaaagaggcattgaggaaaggcaggagacacagtcttgaatcaccaacaccacaccttcccaatcacccagcactggacgtgcagtgcagagagggaatctttgcacttttggaagggacagtacagctactgggggactttacattgaactaactgctgtgctgtcacagtagagaaaaaagccatgctggcctcagtcagtgcctgtgcacggagggaatatttgaactagccccagccagaagggaatcgcccatcccagcagtcagaactcaagtttcttggcaagcctcaccattgtgggccaaagtgctctggagtcccaggtaaacctgagaggcagtctgggacacacgaactgcaattcctagataacttctagtcatagcctgggctaagagctagaggactagggtggcatgtgacctagggagacaccagctggcatggctaagggagtgcttgcaccattcctcccccacctcaagcagtgcagcccacagtaacaaaagtgactccttacttttgcttaaggagaggagagtgaaaagtaaagaggattctgtcttgcatcttggataccagcttagtcacagtaggatagggcactggacagtgttgtgaggacccatttctaggctcagctcctggacaacactctccaatcaagagagatacagtgtctcgaccaggcatggtggctcacgcctgtaatcctagcactttgggaggccgaagtaggtggatcacttgaggtcaggagttcgagaccagcctggccaacatcatgaaaccccaactctactaaaaatacaaaaattagccacgcgtgattgtgggtgactgtaatctcagcctcttggggggctaaggcacaagaatctcttgaacccaggaggcggaggttgcagcgaactgagatcctgtcacagcactccagcctgggcaacagagtgagatgctgtctcaagaaagaaaagaaaagaaagaaagatagaaaaaaaagagagagaagaaaagaaaagaaaaatagatacagtgtctgaatggatgaaaaaataagacccaattttgtgttgacctcaagaagcactcttcacctataaagctacacacagactggaaataaagggatggaaaaagatattccatgccaatggaaacccaaacatagctggactagctctacttatatcagaccaaatcgatatcaggacaaaaactgtaagaagagacaaagaaggtcattatataatgacaaaagggtcaattcagcaacaggatataacaattatatatgcactcaacactggagtatatatatataaagcaaatatatatacaacactggagtacagatatataaagcaaatattattcgagctcaggagagagaaagacctcaatacaataacagcaggagccttcaacaaccccactttcaacattgggcagatctcccagacagaagctcaaccaaagtagtaacattggacttaatctgcactatagaataaatggatctaatatttacaggacatttaattcaatgagtgtagaatacacattcttcttctcagcacacagattattatcaaagatagaccacacagtaggtcacaaaagcagtcttaaaaattcagtaacaatgaaataatatcaagcatcttctctgaccacaatggaatgagactagaaatcaacaatgaggaattttggaagctatacaaacacatggaagttaaacaatatgctactaaatgaccactgggtctatgaagaaattaagaaggaaattgaaaaatgtcttcaaaaaatgaaagaaaaaccacataccaaaacctatgggatacagcaaaactagtactaagagagaaatttacagctgtaggtgcttctatcaaaaaagaaaaaaacttcaaataaatcacctaacaatgcaacttaaagacctagacaagcaggagcaaatcgaacccaaaattagtggaagaaagaaataataaagatcagagcagaaataaatgactttgtaataaagaaaacatacaaaaagtcaacaaaacgaaaagttggtttattgaaaaggtaaacaaaattgacaaatcttgagccagactaatgaagaaaaaagggagaagacccaaataagtaaaatcagaaatgagaaaggagatattacaattaataccagataaattcaaaggctcattagtggctactatgagcaactatatgccaacaaattgaaaaatctagaggtaatggataaattcctagacacatacaacctaccaagattaaaccataaagaaatccaaaacctgaacggaccagtaacgagtaacacaactgaagccttagtaaactctcccagtaaagaaaagcttgggacccgatggctgcactgctgaactctaccatgtgataaatattgatgcaaaattgatgcaaaaaatattgatgcaaaattgatgcagagtgaacaggcaacctacaaaatgggagaaaattttcgcaacctactcatctgacaaagggctaatatccagaatctacaatgaactcaaacaaacgtacaagaaaaaaacaaacaaccccatcaaaaagtgggtgaaggacatgaacagacacttctcaaaagaagacatttatgcagccaaaaaacacatgaaaaaatgctcaccatcactggccatcagagaactgcaaatcaaaatggattaacgactaaaatctaagacctcaaactaagaaactactacaaggaaacattggagaaactctccaggatatctgtctgggtaaaacaaatcttgagtaatatcctataagcacaggcaacaaaagcaaaaatagacaaatggatcacatcaagttaaaaagctcctccgcagtgaaacaatcaataaagtgaagagacaaccaacagaaagggagaaaatatttgcaaattacccatctcacaagggattaataaccagaatatataaggagttaaaacaactctataggaaaaagtctaataattagatcagaaaatagacaaaagattcgaataggcatttctcaaaagaagacatacaaatggcaaacaggtgtatcaaaatatgctcagcatcactaatcatcacagaaatacaaagcaaaactacaatgggatattctctcaccccaattaaaacgacatatccaaaagacaggcaattacaaatgctggagagagtgtgaagaaaaggggactcctgtacactgttggcaggaatgtaaattagtacaaccaaaatggagaatagtttggaggttcctcagaaactaaaaacagggctaccatatgatccagcaatcccactgctgggtatatatcccaaagaaagcaaatcagtatatcaaagagatatctgtactcccacgtttgttgaagcactgttcataatagccaagatttggaagcaacctgagcgtccatcaagagatgaatggacaaagaaaatgtgatacatatacgtaatagagtactattcagccataaaaagaatgagatcctttcatttgcaacatcatggatggaactggaggtcattgtgttaaatgaaataagccaggcacagaaagacaaacatcacacgttctcatttatttgtggcaggtaaaaatcaaaacaactgaacacttggagatagagggtggaaggatggttaccagaggctgtgaagggtagtgggggggttgagggggaggttgaaatggttacttggtacaaaaaatagttagaaagaatgaacaccacctactatttgctagcacaacagggtgactatagtcaaaacaatttaattgtacatttttaaacaattaaaaaaatacaattttactgtttgtaaaacaaagaataattgcttgaggggatgaacatcccattttccatgatacttgcatgcctatatcaaaacatctcatgtaccccatatatatatatgtaccccacatatatacacatatatatgtgtaacccatatatatatgtaccccacatatatatatatgtaccccacatatatatatgtaccccacatatatatataccccacatatatacactatgtatgtgtgtatatacatagtaaatctatttatatatagtatatgtttatatatagtatatatttatatatgtgtgtttatatatacagtatatatatatatatatacagtatatatatatatatatatatacacactatgtacccacaaacgttaaaaataacatttaaagataaaaaattttgaaaagtggaacataaatagaaatttgtacttctctgtctgtctactgtatcttcttctgcattgtccccatgactgaatccacgggattcctttcttccagtcagtaaaacagtggccatggaataggatatgaacaactttcttaagttcaggacttgcttgttttttaccccttacttcctaattctaccaagctcagaaaccaacagtaagtattttgtattggcacatatacctatacctgggttgtggaatgaagatccagtcttgcataaaaatcttcaaatatggtagagattaattctaagactgcaatgataatccttcgtgagttgtcagcatcctgtatgtgcttatcatgtatcttcccaactacatatggcattgtgacaaatagaagaggctgctaatgctgctatagctgaatgtctcatttaggaacaaacaattctggaaaagctcccagattatgcatctgtccctctagcttccactttaaaagataaaattctatagtgataacgtgaggattagtatactattctttccttatatgggtaatgtgaggttatttccttaccttgacatgaaagaaaattatttattgaatgtctcagtagaaagattacaactgagatagcaaattcttatcagaaactcacattaggaatgggcttgcagaattgcatgctcattccctactgtctgaatacagagacgattagggactttctcttcgaatctgatttatttggtttctactcctgttttctctcctttcgtttctttcattttctcatttttcttcatgtagcacaaatggcagccagagcctgtgagtgctttaatgctgcaggcttactgctatgagaactgaacaatggagaaatccctggggaagcagcttccaactgtcccaccctcagcatcctaatgacctgtggaactgtggttccagaatggtggtgataaatttggaaaatactttctctaaagcagtagtgcccacatatttatctgacaggctgtactgggcaattataaaatgttcaggggtccatggtgaaatgccaaaaatagaacaatgcggtatgcttttcctaaagctacaccttctttattaaaacaattatgatttatgtccctcctgtacttaaagtacatatttattatttttaaaatgtaagtataaattttagttcagtccagcattcacacagaaatgtgtacacatcacaagtgtatggttccataaacttccctaaaggaaacacatcaatgcaagcagcatccacatcaagaaacaaaacattacccagtccctagaagcctgcttcagcccttgttaatcacaactcacaaaggtaactcctatctgacctctaaactccaaagtgcctaattttttagtttcatataatagattcatacagtaagtgttctcttatttctgacttactttatacaacactgtgttcatattttatttttcaacatttcctttattttatgaaatattattaataagaacatttgattaattaaatgcccttatacttctttctctaatttttttagaggtttctttttttgctatagaaatgtaataatatagaaataaatactcttagtctcatgtctattttacatcatatctaaagctcagaaccatcttgaatttaactacttatatgggtgggtaagtcaacccaacatatctgactaagtagaattccaagaaggaaatactgattttaaaacattactttcttgatgtttgacagggaccttgttgttacacaataatgccatcttatggctgtacagcaatttgtagtctagaaactgccttcattttgatgatagcatttgaactgttctaccctcttagtctttgggaagtcattttctaaaagtgggaaacactcactaatggcttacaggatagtaaagatggtatcagaaagaaactaacgacaatagagtataacatctgacatttagtaggcccttcttaagtgttcattgaaagaagaaaagagctttgtttctctaatcccagatagatcttatgtaaattctttgtttttacatgtttcctataggtatattttataagcagttagttacccacccgaaaatcaatgaaaactgaatttagcagtaatattaatttcccaaaaagttaactagtaatcttacatataggcatatctatccatacgttcatggtgcttgtggatttactgttgactgtgttgactgttagtgaacaatcagaatgtccgtgaaaataaggcttttaatactttgatgatgtgtaacttgttgagatacatgttgaaattctatttgctgaaagacaatgtatggaagcaggtatgttagataatgaatgagcagtcataaattagtctggctttttaaatatcttcctgttctcatctaaagcgtaatgtctgttttaccttatgacatttaatagagatgactgaacgagaaatacgcagatgtactatttagtatgtgcttaggcaagtcacataacatctttgaaatatagttttctcccttataaaataatgaagcagggcaaaaccactaaggcattttctagctgtaaaacaatcctgttataaattattaactatctctaataatttgaattatggttcagcaaatattaacatctctccccccttccactgtaggaagagtctactttctcattctattgatgtcagatttggcaacgtaatttgctttggccaatcaaatgtcagtgaacttcacaggagcagaggccatgagtgttcttgggaggtttaggtttatactttggtgactggtcatgaaaacatgtcactgacccttcatcttaggtccagagcaaagacatatatagcagaccttaatccaacatgcatcatggaacctagctctactaacccacatcttgaagcagagcttcccggccaagcccagctgagtcagtcaaggtacaagtaacctaaacagccagaaatgcctgttgttttcagtcagcaagttctagggtgatttgtgtcacagcattattgcggtcatagctaatactaccatacatgtaccatttaagaaaaataccaatatagcccttcttactagctcaaatttattttgatttaacccaaattggcttactaaaaaactcagcagatttttgttgagaacaccacatgaaggctgtactgaacatttgtgtattcaggaatgcatagcttctaaatctctccaaggattcaagaatctaccattgtatgggacttagtaggacacgaggtgttgactgccactacaatgaagaacaaattcagctatttattttccctgatctctggcaataagaacctagttctgtggcctaaacctgtattgtaacagcagtcatcaatctatggcccatcagcaattccagcctgccatctgccttggtaaataaagttttatttaaacacaacatgtccatccatttatatattatacatggtttttttcaccctaaaacagcagagttgagtagttgtgacagagactacatgacctgcagggacaaaaatatcgactaactgcccctttacagaaaaaaatatccatcctctgactatcagatgcttctgccagagaccctagttgtagaatgagcgacacacagcaagaataaataatttagatactttttttttgcagtgacgatagcaagcaatgtccagtgcaatggtgctcctggtaaagcaatggactctggcatgacagcaaaataattcagatttacctcatagcttgatagtagatatattctggatgcctagcctgctcttcctttatagtttctgcccattgttaaacctagctctcaggctttcctattgattccatgaggtatctgatatccttctagtaatttatataattctacctaaagtaactagagtcactttctgttagttgtaactcagaaccttgaatggtctatagaccttgacttattccccattcttagtaagatagcttcattccattccccagggatcttgttcttgccctcttgtacagctccagtctatcaacccttattttactggctggttgtgccttttctctccaagactgtgaagctcttcaaagcagggactgagtctaattcttctctctgtagttctcagggaaatttgaaagcatgtaagaatgaattaacagatatcatgactatcagaaccataagatcaccattttcatcatcaaaattgccaaccttaactgagccattatcgtgtttaagcaacccactaagctccccacatatattgtgtcagataatcctcataacaaccctgtgacatagacactattcttatcctattttatacatcagaaatgtatggagcagaagatttaagagacttgctcaagggcacatagatagcagaaaggccagaattccaaaacgggttggaactctagagcctgtgcttataagcaattacttaaaacagtttgtatctgagattgtactaaaagtcataggaaatttaacagctcctgaccaattcctatagaatgtcaatggaagtacaatttcaacctctggataaggacagggtggatctattggggctagagaaactctatcctttgtcaaaaccagaaaagtcctcagagttggggtgagatttcagcgaccctctctgtggaatggcgttagtgtttctgtttaagtctaaggtgaaggtaaactgaaagggaaatgtccatatgacccagtgagaagggaatacctggatcatttgccaaaaattactcatgagtaaagcggaggagaaacctcaaaaagcagaaagcgttatttctactttagtgcaaaactggtaggtgtatatagaagcacagtaatcactggctatccaagaaacctcaacggtccttaggggatggtgtgggtggcctagaatgcttggagaaaacactgactataagaagacaaaccagagggggaagaacttcccaagagtggaatgaacatcccaaaagatggtaatgaaactgacatcattggagtagcccgcagagcctcataatgtctcaatgtgaaatgctgggagaaagtacaccatggtggcgatataagtttattcaaatatttttgttaatttattttagagagagtctgttactcaggctgtagtacagtggcacaatcatggctcgtggcagccttgaattcctgggctcaagtgaccctcctgcctcagcctcccaaagcacagggattacaggcatgagccaccattttataagtttaagtttgtatttgtagcatatacacagagtggctgagtttctttgcctttatcaagcctggctttggatactgtgggaccagctattttcaaggaagttgagataaatctgtttttttgttttgttttgttttgtttgagacggagccttgctctgtcacccaggctggaatgcagtggtggatttgggctcactgcagcctctgcctcctgggttcaagggattctcctgcctcagcctcccgagtagctgggactacaagcgcatgccaccacgcacaggtcatttttgtatttttaatggagacaaggtttcaccatgttggccaggctggtctcggactcctgacctcaaatgatgtgcccgccttggactcccaaagtgctgggattacagacatgagccaccgcacctgccctggaaggtgcagtgagataaatctggtagactatccaaaggggaaatattctcaggtttcggagaggaggcttgagtccagacacattgaacacccactttgtgctcagcactatatcagtcctgagcatataacacaaataaaacatagcccttttctataaggagcttgtgtgggaggcagaaaagtaaacaaattgattactatgtgttaggttttaggagcaggcacatcagatcatatattctacacggtagccaccaagtctggaaaatttacaaatgcataaatgatttattgatattaaattacattaaatgatgaaacaatatccaagtttccagatgttaggagcgactaatagttttaggatttctagaaaaagacaacatctgaagtgagacctgaagaacaggcaggtcagagggagtacaaaacacttgggcatctgcaaattgatttaatatcgctagaacataattggaggggcttgctatagggcaggcacgaagaaataagcagtgaggctgaccagataattttgcacaattaaggagtcagggtttcattctcaagggaatgagattatagtaccaaagctcttacactttagaaaaatgacggccactgaaagatcgttgagaacaaagtggagataatcacttgagacaactgagattaatgctagaaatctctctttaggtgcctgatgtagtaaaccaagaactaaaataggagtaaagatggttagaaatggacagatgtaagagataccatggaggttccctataattattagacgaatgatttgatttcctctgagaataattaagaagcctaccttgaggataaagacttctgaaatgaatcactttaagctgttagagaactttattacttttaatctaaaaatgtaaaagaaagagtaatccacttcttgtgatgtgaagctaaataatgtaattgaatttctgccaccccccaattaagtcaacagctaaatatttcaattaagataaaaagaaacatgattttaaatcaacttaacaaattccccatggcaaaaaaaaatgtgggggagggtaatgcaaagtgtaaagtgtcaccctccaaaatataaataaatgaaaatcaatttttttattgataggtagtattttaaacatgttaatctaagtatcaaactcctataaatttgtagatacagatttgactaaagataaatatgttatatcgaacaactgtttatagcacctcaatgccccaatctgatttacgattacctgaaattttagaagatataatgcttcaacataacgctaaatttaatactgaataatttctacagttcagctcatttgtctgaattgttcatcattatttgttctcattttacttaccatttttcaatgagagtgatacttctttttccctgtcttttttccatggagggtactgaaataaattctacagttccctgaaaacaaatcatttctgcaagtatcaagaaaaatatatgtgttacctacccttgtcggtccttgtacattttgttaactttttcccattggaaatcaagctgggagagagcttcctgtagcttcaccctttccacaggcgttgcactttgcaatgctgctgtcttcttgctatgaataatgtcaatccgacctgagctttgttgtagactatcttttatattctgtaatataaaaattttaaaacagtaaaaaaatgaattagctgtctatagaaagagaaaaatatatatatatatacaaatcccaaaggtagcaaatggtgttgcaattcttaattattgactttttaaagttaataaccatgaagtccagtgactttgacatgttcaaattcaataggtaaatcacagacctcatcctgagagagtggatcgctccctacatcttaaaactgccttcatttggcttctgtatcctgacctcttctgctttcctttgctggatccttctcatcctgatcttaatattagagtgctctgactcagtatttgcacttcttttcttctctgtccataatccatcccatttgttctcataattttaaatatcttatataagacaatgacacccaaatgtgtatctcaagcccggacatctcctccgaactccagtctaacaaatgctaatttctcaacacttggaggtctcacgagactttcaaacttaatatgacgcaaacaaaattctgaactgcatttcctaatccttctcatcccatagattccctcatttcagtaaatggcaattactgatttcaattgaattatagtaattcaattaacaattactcagattgacaactttggagccatccttaattttttcagtctccagtattcaaattattgggcaaatgttttggcttgactttcaggacatatgcagaatttgactgcttctcactacctttcttgctacagatctgatagaagctattattgtctctcatctgggttatagaactacctatctaaatggtcctcttgcttccgctctttcccccctactggataattctccacacaagagccgaaaagattcttttaaaacataattgggatcatatcactcctctgctcaaaatcttctggtggctcttcatcacagagttcaatcacagccaatttcaaaagcctacatgaaaaataattattcttgcaacactttatacaaataatcaggccaagtataataaagcaaatcagtcctatgatgatccatctttagtaaaaatgggagactggagagagaaaaaaattatgttttaagaactatggtacacctgttattagtctcgtcagctgtttttgagttttttcctgcaatatagactgatcctgcttattcctgtgaacctgccagtgatctctgactgcacctcagaagaaacaagaaggatgggtaatataaaaacctggatcagtattctaattctgggcatgtattggaatcagctagcagccccacatcactttggttccaacagctgcccagttcacggaaagccttctaatttagtttacttgggataattttacttattgtgttttactgttgtggaatatatttgctgttttactttttgtataggaatgcagaataagcttactcaatgttttcttagattgaaaacttactaatcttccagatatcaccatttatcagttatgaatggccctcaccaagctgatgcttgctgactgagctcctctctaccctgaatacaagagaccctaatagttaggcagaaatatcatcacccatattcagcctgaagaagttacagaagatgtattacccttctactacttaatcctaagggtaactctactacccttaggattaagggttcccttgtaaaagaaagaggggaaatatgtcagaggcgttcgaactagaacaactccatcttgaataggggctgggtaaaataaggctgagacctactgggctgcattcccaggaggttgggcattcttagtcacaggatgagataagaggccagaacaagatacgggtcacaaagaccttgctgataaagcaggttgctgtaaataagctagtcaaaacccaccaaaaccaagctggtgaaaaaagtgacctctggtccttctcactgctcattatacactaattataatgcattagcaggctaaaagacactcctagcagtgccatgacaggttacaaatgcatggcaatgtcaagaagttacccaatatggtctaaaatgggagaaaccctcagttctaggaattgctgactccttttcccagaaaactcatgaataatccaccccttgtttagcatataatcaagaaataactacaagtatcctgagtcaagcagcccatgccactgcactgcctacggagtggccattctttattcctttactttcttaataaacttgcttttactttttttaaaaaagcataatcttcactatgacctataaatctctacatgacttggttgtatactacctaccattccaagctcatctcttcccagtctcttcatagtccacaacacttcaccctcattaggtttattgcattacttgagtataacaactacattcttgcttcaagatttctgcccttgctgttctacctgccaaaaatagttttcctaacccacatttctatcagtggttcccttacttctttctcacgttaaaggggccttctctactactctattttaaatagcaccagcaatcactctttattcctggcattactcttcccttttctttatagtacttattactaacattaaaatatatatcaagtagccggtatataccactaatttgaaatctatgactacagggatgttgttatctgttgggcttccaaagctcaaacctgtgcttggcacatgatagatggcaaaagcttttttgttgaataaatgaatagatggtcccataaatttaatccataatgttttgtttatattctatttaacggaaaaatcacaaaccacaaatgggttatacgggaagaaagaaaaatctaaacatatttattctcaataaatttgctaaaaactacattctggctattcttcctagtacgaattttgttattttgatcatctaaattatacataaggtccactgagcaaaatttattgagttcttcccatgtgtaaggagcaatatagcagaaacaaaggtgggtgaaacacagtttagtttgcctttaagaagttttaagtaggttttattgtagtagtaagaaaggatatggtttgaagaattgaagaaaaaaatccaagtatagaagccttagctggatgagaagaaggaagaaatgagtgttccaagtggtaccaaacattttctagaagttagagaaaacatgtatcatatatttggtcataggctcaggaaagaattcacgaagaaggtgcaaattgcagtagacatatctgagtagtagaagtgggaagaacattagagctagtaggtaacacacacgcaaagctaggtaacaagcgcagtcatatttggctgccttttcagtaacatagaagcttaggggaagatggggcatgaaacagaggctgaggatgttcaataatgtgctttgaatctcaacagaaaattctgcctgtacttcagtagctaatggggaactatgatttttaaaaagttatcattatgtaagatttcaaatatatttgaaagtaggaaaataatacaaatagctcccataaccctataatccagtgccaactgttatgactccatggacaatccacccactcacctcttcaactagattattctgaaacaaactgatatattattttctccataaatacttcagcatttttctcttgctgaaatattctctcatgagaacttttttcggaaagtacatatataataccattaacacacctacagtcttaacaaaagttcattaattgaatcaagtatctagttgctattcacatttgagctgaagtgggaaggaagtttaggaaaacagctcagcagaattcagtgactgtgtgttgggtgaagaagaggaagaacttgaatgagtcttaggtatctggcctgggcatccacatgatttgtggtgtcattgggtaacaggatttcagacagatgaagaggttccatggttacatgcttgtgtatgtgtgcataagtgatcagttcaattttggacatggtcattctgaaaagcctttgaggcatcaaactgtagatgttccagaggcagttgaaatcagattttgagaagaggagtaagatggcagggattgctgagccatacatattttcacatttggatacatggactaggctttctgagcaaagagttgtagtaactgtcttaaagggtgactgaatggcaagcgtaccttggagtttagtgcattgctctggagagatttaaaaacttttatctccaagagccctttgattacatttcaacttatattccaaaaataatagacctagatcattggtttatagcccagagcaaagtctctgtcttcctgtatgtctgtctctctcactttctctcctcctgatacatcaggtgctctatataatctccaagatccacaattctgggatttctctcctgtactacaacccctgcactcacagataaacatcttgccctgagatgcttttgagtaattaatgatgtattctctcatccagagatcttatgtttcctgactagataaatataaattttaacaaatatcaacaaagggaatattcttttttttttttttttgagatggagtctagctctgtcacccaggctggagtgcagtggtctgatctaggctcactgcaagctccgcctcccgggtttacttacaccattctcttgcctcagcctcctcccgagtagctgggactataggcgcccaccaccacgcctggctaattttttgtatctttagtagagacggggtttcaccgtgttagccaggatggtctcgatctcctgacctcgtgatccacccgcctcagcctcccaaaacaaagggaatattcttgcctattttcagtcaaaattgggaagcattttaatcatttgtaagttggagactgtgttagatagggagtgactgctgctgatcgtacagctttccagatgacgggctctgaagaaaacttcacaatcagagagggaaacaggaaagaagttaacaataaaacttagaggattttctgccttattctaagatttcacgtttgtggtccacgaggacttgccttgagcaagaactaagctgaagaggcaggtgagactacagataatgtcagttgtaaaaggtaaaagtcaatgcttacaatgggaaccttataaaaagcaactgtgttctcgtgtcttatttatcagctcagcaacaggataagatacaatggttatgggtgatgtgagtgaatttcagagaaagaaggtgtttttaaaataaaatttcaaggcattctcttccagtctatgtacaccttgtgatggaaagctttcattatttcttttgtttcgcacctcaatttaactctgtggaaaaagtacttatctgacaggtcaggtattaccatacaaaagaaagaacaagccaacacagaaacaatctgagaatttacttatctggaggaatgcaggttaaaactgtcttttagcaatttcacatagagaattgatagtcattggaatgtgtgtgatgttgaataagactagggatggtcagattgctcaggaaaggtgtttagggtgaaaagagtgagaagaaaggtagcataaagatgaacctatgtggaaagcatgggcagaggaaggagatgagtatccctaaagaataatagtcatcagacccaggaagagaaccagaaggagggagggagttgtcaacaagtcagatgcagccaggaccaggagggaaaagtcagctcgggcaatttaggaggtcattggtgatcttatcgagagcaacaacagcatgttggaagtggaaaacataaatgtaggcagaccagactgtcttttgctgtcatcatctttcactataaaatagaaaatagctttgtacgacattgcagtatgctgtatttgacatcagaggcttgcttattgaagaaaagtttcatattgataaaaacaaaactcataataaaacagaaactgttggatactatgctcactgcctgggtgatggggtcattcatatcccaaatctcagcatcaaacaatatatccatgtaacaaacctgcacatgtattcctgaatctaaaatacacttgaaattataataaaagagatacaatggatgtaatacctgttattaatgccctaaaagccattgaactcaagcgtatctctagtattatttctttacttttatttacctggtagaattttactaccatcttctgatggctccaagcctggagtcttgggtggaatgtttagggctactccgctagcctgattaggtcaggtaccagaaacgtgcaccaacatatcttcttggctgcttctgttaacttgcctgacctgggcagcctgatttcacaagtacttgattcaactctgaattcttttaagtcactgtctccatcattcttgcttggctgccagtccaatggcaaagatacataactctgccaagtcctccacctgataccaagactccagctgaatgaaaggctgattacttaaattcacattgggcaaccaatcacatttgttagtacatagcaggcccaaaccctttaaatgcatagctgtaagcacccatggagaaaaacattcaagggaagagataaaggatcttccccatcagcatataaaagttatccagttatggctttgatatggtatgcgtgtgtttgtgcgtatgtgtgtgtatgtatactctctgaggatttgagcttgcaaagcttcctgattttaatctgagtctctggggagctaccaattctttggaatgctgtagcattgctcagcatcaagttatgaacggttttagcaatgctgtacagcatgttactaacgcgggaaaactttctatcttaaaggagaaaagcaaaaagcaaaaactggggcaggggatgtcacactccctggatatctagataatagctccttggtgcattctcagagaatgctgtcaaaattggctggagtccaggaaatacatcctttttaaagtccctgcacatattcgtgtcctcaaggcactgcacacagaaaaatggtatgtgcaccaaagaaaatgctgtagcactttccatagtttaaagtcagagatgagatctctgatagtattttactattttagtttgtctagaaataagtgatctttatagtttctgaccctctaaaaaggaagccatagtcccttgtagttgctatggcgatataaacatccctagaatcactatagaatatagcatttctatttctctccctgaatagttccttatcttatctgaaaatatgatgtcaaaatgataaagtaccaactttttagtcaaatcccttcttaattttgacatgcccctatgaattgaccacttcactattccgctgaaattctgtaagatgtttatttttggccactctttctgcaaaaggaaattctaaatatacatacaaatggaattttaatttctgaaaggcatctgtacacgaatttatacaactcgagtccttaatattttaaaataggatatttgcatctctgattcacagtctccaataagttaaagaagaccctgattatgcactgtgaatagagaaaaattagatagcacagtaacttttacaaccggcagatgaaatccagatacctaaagtaaggaaaagcagaaatctataagccatgtggcttcaattcatttatctgtttgaaaagcttattgtttaaataagtgtttattgataatacagacataatatcagcctcaaatgtgagatatgaaaataaagactttaaaatgtgagtctctcccttaagaagataattggtttttaaaggagacacatacagaaataatttgaacataaaaatgctttgtttattcaagtgttgtggagtatgtgtctttaacaggataaaaggagaagccagagaatacagaaaatttatctaggaaacaaacaagggacctatttgccaactaatcagtttaagataaaggtatgaagcaacccttaactatgctccattctttatcataagggatagacttctactgtttagtttttcttccatttaatgtaaagtgacaactactcccttgctgtcaaagattttcattgcagagcctgcctttaccatctaaatggtaaacttatgtgtataaatgtcaaagtagatattgcagaacctgaagagaactagagtaggggagagtaatatctgacaaattgaacttactgttaatcacttttgatgaaagtaaacttaaaataatttactgaagttttaaatatatttttgtacctatagcaaagctcgttgcttcccgaatactgtgaaaagtgccaaagttctattatttaaaatagcagccgggcgcggtggctcacgcctgtaatcccagcactttgggaggccgaggtaggtggatcactttaggacaggagttcgagaccagcctgaccaacatgtgaaaccctgtctctactaaaaatacaaacattcaccaggtgtggcggtgggcgcctgtaatcccagctacttgggaggctaaggtaggagaatcacttgaccccaggaagcggaggttgcagtgagccgagactgtgccaccgcactccagcctgggcaacaagagtgaaactctgtctcaataaacaattaaacaaacaaacaaacatcacttcctctgtcccgtctctgtggtcattcaattcagccatttcttcatcttcaacatccaattactaaataaggatgtctataatttacaagtgtctttgctcccttatttcatacctagaaataagctcacatataccttcacaaatctacaactctttccaagattttaaataatatgtccactgtgggatgtatatacaaacattaattggctaatttgtcttctgtttaacagtttttcctcagtaataaaattttacatcagaagttgtgagtgttctctcagtcaaaaatttcaattagaaaaaagtcttcaaatgaaataaaatttcaaatgtataaaagcataagttaaaatataagataatatgaaattgttgtttcagggcattttcccctgaaaatgacttcagtatttcgatgatattctggtttgaaatatattgaactttattttttaaaagaagtgataaaattgctttctaatggtttctcagttttcatttctctgaaggactaacattagcagacagctggaagcacttataattcacatttttaaccatatttatttcctgaaggaaattcctattcactcacttagtaatagcttccccatttcatctttccctccttggcaggattcagtacagttaggcacagttttcatcatacagacctagccacactagttttaactagtaatactatcttctaggtttctctctctgtgtctgacagctacatcgctgtattcattcattaactcaagaaatatttgttgaaaaaacctaccatgagacagtcatattttatttatttatttatttatttatttatttatttattatttatttatttattttggagacagagtctcactctgtcacccaggctggaatgcagtggcgcaatctctgttcactgcaacctccacctcccaggttcaagcaattctcctgcctcagcctcccgagtagctgggattacaggcgcccgccaccatgcccggctaattttttgtatttttagtagagatcgggttccattacgttggccaggctggtattgaactcctgaccctgtggtcacccgccttggcctcccaaagtgctgggattacaggcgtgagccaccgcgcccagcctgagacagtcatatattatatcttgggtatatactagtgatccagaaagcaaaagccccgctctctggaatctcaccttctacaggagaataaagtaaacaaatagagaaatgactaaactatatactcagttagatagtggttaagtgctgaggagcaaaactaaagcagggaaggaagaaatgaaggataaagtgggggtcagaattttaggtaagaggggtcggggaagaccttaccaggaaggcagtttttaagtaaagatctgaaggaaatgcagaaattaaccattgaaagaaaaatcatgagaataatattccagacaggtaaagcaagtataagggccctgacactggaatgtgcctggaggagtggccaaggaacatggaggaagtgattatggctggagtgtatgagctagcgactaccagagaaatatcagagaatggggtgggtaacccatgaaggtacttatgaacataaggacttccctgtttactttgagggggatggggagcattgggggttttgaacagaagcagaaagggggatataatctgactttccatttaaataggtatctctggctagtatattgacagtagagtctacaggggagaaggcaatgagggggaaacttgttaatagacaactgcaatcatccatgctggagatgatggtgctttggatcagagtggaggcagggttgaattccggatacattgtaaaggcagaatccttaggatttggtggccaattacatgtgtgttggtagagaaaggccttaaggataacatgaagaattttggcacagacaagtggaataatggagttgccattaactatagtgtagaaaactgcaggaggataaggttagggtgtaagattttaacatgctaaatttaagatgtttattatacttctaagtgaatatataaaaggcatatatatatatgtcatgattcaggagaggaatcttgactagagatataaatttgagagtcactaggggtaatttttaatctcttccaaacttgctcagaaaatactgatgttttgctatattccctttccagacctcttttcttccaaacccaaccctgtagacaatcttagccatttctatcacttaaatcaaactttgacacaaaggaattttatttaggggaggtgggaaaggggataagaaaaatgtcaagttgggagcatagattcactgctgctggggcccaacagagaaggcacccagcaggaggagggagttagccctttgatggttgattctgcttaaggctacatcaaggtgttttggggataacagaaatcgaagaagctagaagaaagtacagggaaaaaattcaagtctacaggttggtagacagtcagagactcttggttctgttgccatggtgggattatatacaccttccagaaaacctttccttaaccaatcagagtatttatttaactagatagaaatatgtatcgggaaatccagtccacattttgcactaacacaggaaaatgggtgatctaggatgttgggcatctcctgagtgaactttaataatgagagtcctggtacagctactgaatcaagggtatggtttataaatcggtccagctatgctgaacacaaatatctccttacttattgttttatctctttatttttccttgtgtccaatttatcctgccattttaaggattatccctgaccaaaatccatccatgatgacatatagctttttggacactttcaagcccatcttttagcccatctttttttccaggaaaaaaaagaaaaaactggattcacagtttttatccaacttgatttcctagtgctttgccagcagagacacttgaaaggataatcaaagtgaataacaaagtgaaggattaatctctttgttattcttcagacacatccttctgatacaattttttttttttttacccttactgactttgtatctttaactttgaaaacattttctgcatcaagaaactgtatagcgtagtgcttaagagcagaaactctggagcttgaacatccagagtgggacttcaactatgatatttaaaaatgatctcacctgagcaagtcacttaactgctcaggacctccgtttctccatctgagtatgggtataataatacagccttccttgtagggctgttatgatgaccatacaagttactctaagtgtttagaatgtgtcctggcacaaaaataataactgtcagctattacattcaagattagtccagattccagttatattcacacctcaagctaaggattcctcctctataaaattcctcctagtttctgctttttgtgctgctttcttcttttcatgatttcagttacactcatgtcttatatatttttgcttggatgatgtccttaatgtctttattactctctaacttgtttgtataactataatatgtatattcaataatgttatcaactaccagagtacaaggattattccttaatatttctttcttatcttttagaatgttaagcatagcacttgtagcattaataaatatctgttgacttgaagtaaaaagttgagttgaacttgcttatgaaaatccaatttgaattcaatcattgaacctctaagatttgttactctgttcaaccattgtagatagatattcaggtatggtcagacgtgagctattcaggtaattccttgtttattctactttacttttacaagacattagctgttgaacagtggaatagaagtccacatgcatttcctggctgagtttccttatggtttcctcacagcacattagatatctaagaaaaaagtcctttattcagaattacacctgcccatttctccagatgccacagagcatcaacaagaacaaaaagaacaacaaaaaaaaccctgcactttactgatccaagtgtttctcagataaaatgattctagtccatcagcactaagtaaattgaaaacaattttaccagtccttttatgatacgtacattttgtgttaagttgtacacatcgcctaaatcattttacagaaaatccaaatagaaaaattgactcacatgcatggcaaagggggttttatagaagtaagtacttttctcttagttcaaaatatatggcattctatgatcccaaatttcttagagtcaggatacgctttagtgttgtgtgactcagcagaggagggccaggtaggttttatggaggaaaaattccaaagcaatacaacaatccaagaaaacctcaaaaactgatgatcaccaatgaatggaatatgcttttttaaaattcatgttatactttttaattctatttacatatgcaatcatgagcatcttattattttgataaatgaaaatttagtataaatgattaagcaacttcataggtagctaccatacatgataaaatataatcaaacctgcaaaaattaatattgatgacagtaaactattttggtaaaacagaaaacatatttggtaatattatgcccgttttatatataactaatacttctgatgttggggaaatgtgctttccatcatattgttttacacaggggacagaaaagcaaaatcgctctttcatacaattgttctgtacccaaatgcatacatctaaaaaaaaaaaaaaaagaaagaaaagaaataaacaaaaggcatgatatgggagcaggaagctaacactctactcaatgtttacctttttggaagctccatagatttccttactgataacactatttaatttttgcctgtggtttggcaaattaaatttgggaattggtgtctgttaatcatacgtgatttacaacagaaagttcttgttttttttccatcaggatgtttaatgatatatattaatattcagaaataagcagacttgggtacaagtcattgtattaaactataagatattgccaatatttaaaccttttgaaagacttgacaattcataaggttcaatggaatagcattataattttaatatgttcatggttacaaatttaaccaggagaaaataaatacaaactaacttttttaaatggcaaaggaaagacaacaaaaaataaacaacaaaagcaaatttcaagactccaaagcaaaaaagagaaaaaaacactactgattaaatcattctttgcttagagtttcaatatttttcaataatttttgtcatggttctgaactcacaattagaacaatgggttttaagttactgaactagaaatggaaaaaataaatcaacacatttcataaagaaactaaagcccaaaataaaacaacaattaaaaccaagctagaaaacagcatcctcttcttggtaaaagttatggtacacagaatcttggaataatttagagttgcatttctgcacctcaagataaatatacaataaagtgagttatttgttttataccttaaataaatagaagaataaaaaaattactcctgaataagtaacaactagcctcggaaatacacatggcccccgtcttataatgtttctacttagtgatttttcaactttagggtggtgagaaagtgatatacattcattcgaaaccatacttcagtatagtattcactaaattgaatgagatattcaacactttactataaaataggtcttgtgttctatgactttgcgcaactgtaggttaacataggtgttcagagcatgtttaaggtaagctaggctaaaccatgatatttggtgggttaagtgtattgaatgcatttccgcatacaaaattctcaacttacaatgggtttatctggatataaccccatcacaagtcaaggaacattctgtacaatagaagaatatgatcaaaagtttgtaagatcctctaaggaagattttgtcaaaagcaaacgtggcttagcttgtatgtattctcttattttaaagtttttttagctttagaatatttgccacatctggaaataactttacgtatattttatgtggttaacattttatttacagttttttaagatataaatatgcaattttataatgtttaacacattcttaaaggtaatttgtttttaggatactttacgtggaaatttataactttcttagaatttgggatgtttgatgaagcaatatgcattttacaaatcttgaaatttatataattatacattttaacaggaattttcctacacagtcgtacatgatttcactgtatcttcacaagagtacagttgagtaggcaggggcagttattatcactgatttaatttcaacgttaaaaaacaggcctaaatatcttatgttacttgcccaagggtacaactatcaacaatcaggttaaatctttctaagcttttcaggttccaatacagtactttgctaaactctctactctactgcttatcataaccacataatgaaagctcactgatgtggaaaaatgttagtaatgttttaattatatgtgggttccctgtcacacattttcataaatgattgttttagattcagtatatacaaacctagaacaatttcttcatgcttatatgcatatagatttgtagaatgcacatgtctagatgatttaactcagtgagttaggatacaatataaaaagaagtaaatttggttttctcttttagtaccagcgcttactaacactgccctgtcttcttctatctcagagtccacacctacatgtatcagaccatcactcactaattcaacagatgtacattcagtacctttaagtgctaggtgctgttctaggagttctagatacagtggtggaggaaaaaaacaacaaacaagatactaatttttcttcctggtggctgtgtgtatgtatcaccttcttgaaaaatgtagcactgcagttacatgggttatacatatacttaaatgcatgtatagtgtttatagacttataaaactctaggcactattgtcgtcatattttgggaaggtgaaaataatagctttaagcagttttaggtatcagaaatgccttgagacactttgtaacttggttaacagaggagcacataactttcatttctaagaaaaaaggattagaaaaacccattagtaactgttgtgacagcggccgttggggagtagatctatcttaaaatggaaaaagagaaataagagaaccaaagactcaaactccagttcattttcactctctggaatttgtctttatctgacagataaaggcaacaccctatataaatctaattcttacactcttcacatcccatccagctaccaggcactacattaatgacatatcgaattgggaactgtgttcaatcaaaaggcattaaagtacttattaactaggttttacggagcttccaaaaaaagttaaaaagttatttttggtggctctatggtaaggtgaccttttaattttttcttcatggtttattgtccccatgtgagaaaacactttctaaacacagctacgtatttggaccaaaatattcttcataggatgatgcattgtctttgcataaataacgaatcagtaattatatatcacacataaaaaacgacattataactggtcgaagcacagcttcaaccgtttgtgaataaaaggaaaacctccccacaacttaactgcaacttcaaaatttctaccagcctcatgatttgtaagttttaatatggaagtttctgctttctacactttacacgatggggattatgaaaacagtgctgctgggagaatggaaggagtaggagtgcgttcttaaagtacattttagcagagttgggagtaaattgcagcataatagtcaaggtaggacaactgctaggcttgataaaataatggttggggataaagaatggataatttcctacaagagagatttgtataaaatataaaagaaaactgtaccgaagcacatataaatatgagctgggcatgactgaaaggcagtaaatatctataatctcttctctatagtacaaatcttttcatataatacaaatgaaaaataatgtactatggaaataatttaagcatgatttaaactacagttaatgattaatatttgaaaatacacacatttatatatagcaaatcaatcaaataaatcccaagtcatataagctgttgaagaaacaaattatatttataaccaaataaatgtgttgaaaaactcaatttttctaagagaaaccactgatcacattattgcaaatgtttatgtatagttcaaaagatcagtttctacaaagtcacaatgtattaataaaaatcatcttttccacgcattaaactgttagaactattaaactattagaaaattcaactcgaattcaaaaagcatttgcaaacaaattttgctttgaaattttatatgatccatgattatttagagtaattgcaatgtcctcttattccaatattattaaatacccctgtattacaatatgcatataaacaatgtaatatgcccctgtattacaatacgcatataaacaatcgttcttttattttccttcagatattttgtttggatttctacatatggtgcctcttgctattatctaattctcctaataccagaatagaaaagcagtcactttgctcatggcataattttgccttcatttaactaattgggattattaaatttgtgcttaagagctgtgaaacagattccagaggagaaagatcttaaccagtgtattaaaaatctctgttgccagtacttttgtccctacttcaaggcaagactgaagaatcgaagactaaaatatgagaagaaatcatacatctctcaagggatcttctgctaggttttacgagaccaaagttctaactcagccccaagtcggccgagaatgggttttcatagacacatgcttaagtttctgtatgaccagagaaatatatctgctatctctaatttcaaaatatttccagaatctgacattctctcactaccgaccaagtccaagccaccagcatctctttttcaactcttgttgattctattattggtcccctacagttctactctcaacccagaagccagtgtgatccttttaaaacatgattgagatcatgccactcaactgctcagaaacttacaattgctctcatctcatttagaatcttctttacaatggccccaaaggccctccacaatctggacactcacaactcccatatcctcatctctttctacccttccactggcttgttttgcttcagccactttggccttcttgttggtgcttgattaagataagctcagtcccacatttgggcctctactctatttcctctacacagactccatggctgactcccttaccttcttccaatctttgctcaaaggtcatttctaccctatttgaaatggcaattccgccactttcaattatacctacgtctacccctgtagtggtcctatatccccttaacagattctggtttttttttttttcccaaaatacgtatcacctagtaatacgcaatatttacttatcatttttctttgtttgcttgcttctattctgtctcccaatgttataataaaagctgaatgagggcaaagattcgttagtctttttcactgttttataagcacttagaatagtgtgtggtacatactaagagcttaataactatttttggaatatacgaatccacattccttaggtttacttgtcctaacaattttttgtttctcaagagcaatgcaaaaaacctgaactcaagaggacttgaacgacctggcttcacactatctttggcttataagctcactaccagctttcccttgtggtctcgaacttgaacaagggttgtctctatttcttgatcctatttaaaatctacattaggaccaccatgtctcctacccgtgagctttcttcatatggccacgtttttcatcaccctcttggttacccaaagtatagcacattttattcattccaaacaaggcatctgtactataattggttttgatgagacaactgaaatgatgtgtgcctgatattttttctttccttccatttatttcctccttgtttctctccttattttatttcttttcttcaattctccctccctccttccctcactctctttcttccttacttcctcccttccttcctcctcctttcagtgatttgaaactccagtgcaatgtggaatattgaagggatgtgggcagatatccttgtcttgttcatgttcttcaggtgaagacattctgctctaccataaagaataatattagctgtaaattgattctcattattgcaaaaggtaaagcatagttgtcattcttattataagctatgttcttatttttgtcctaaaaattcacatttattgataccaaggcctaattgaacagctaaggattccctgaatgagggagcagcagaatcacttgaagaattccactccaaaggcatgaactatttctaagaatttctctacgtaaatgctaactacacagtaaatatgtcattatttatttcaaaaatgtcctagatagagttcccctataagcagattcgaagacaagggatgtctttgggaatgatccaaggaggtgctagtaaagtgtgtgtaaggtaggacagggagcaagtgaaatgtatcctatgaggcaggtttttactgtgtgcgatggggtcttaatcctggaacagaattttgggtcagagcataaatcatgcttcagagttaccctaactgaagaatgagtgagtagtggtatttatccaccaaaagttatttgttattggttgaggtttgctggggaacacgggggatgcagaactttaactacctgacactcatgagctttgattactagagagagccctaaggcaaacagtcagagacacttggatctggcagctaccagtcagagtacaaggcatgctgagtcaggaaatgatatgggtgacatcccaagagtgtttcatcctccaataaaactgatgctttcagtaaaattaggcatatggacacatgatgataaatcctttcagttaagtcttttaagtggatcatttctgcttttaggataagctttcaaatatttaactctctccagagaaaaccttttggtaatttaaaacttacgatgctaagaaattctgtgttcatgctttcatatgagatactttaaggcaggatttgacggtttaacacagtaattatattttggaaaattttatcatgaaaatgattttttcttaaaaatgaaatgcaagttaatattgctctaaacttccaaaaaattgcaattcttctaaaattatgtactcttgtctgttatgagtattattaactttgtacatataagcaatcacaatcaattaactgttaatattggctctgaagtaagaaagaaaatattacttatgtgtatgtttctcattcttctctagctctgccttagctagtgtttttgctattaaatgcagatttccacatatgtatatatatatacgtatatatatatgtttgtgtttatctgcatagtctctgtcaacatgattaggtagctttccaattcaatacatctattgaaaccatacgtgctattttagttgtattttgtttagaaagtaattcttttaacatattacatattatttgtgttgtactgcactttcaaaaaagatgtatgttaaagcacagcaatacttactatagttctgtaatttgattcatgcatatctgtcaggaataaaatcaaccacaatttcaaaccttcccaaccagcagctgtacaatttatgcactgcttttccatttttactactggataatgacaatgatgaatgcctttaacaggaaatacatattcactgaaaagactgagctcaaaactatcccccttcaaaaaagtcaatgaaggtaggaagcccattcacctgctggagatttgttgggagacagaaggaatcatgcccacaactgtatcttatggggattcaaccatttagctaaattaaatctacaataataccatattataaaccgcagtaatcaatactattacgattgacatcagctataataatattaaatagatcaggatgaacaaatgattcactgtgagtgtagccaagggtctaacattctgagtatgccaggctaagaggtatggagacagagttattcaatgggcaacttaataagatcagggtcactactctcctgaaccaaatgtccatgaacctgggaaggaatggatattagctcattggcaataatttacttattgaatgacaatgatgcacttacaaactatgctgccatgagaacttagttaatagaaataatgacaggaattctggcatgtcagctttattttattaactgattaggtttcttttcttcattgtaccaataagtgatttgacttttacttcaaacagaataagaaacagtgccacactgacatggatggaatagttccagagatctgtgaagctcttattttactgtgtaattttatagcttatttgatataatgttaagatattaaagtcaagtcactgaagatactgcaacaccgatttccaaaacaaacaaatagctttatccatttgtatattcatacaggcaaatgtgtgatatagaatgagcttccaggaaaccatttgagtataaaatactttagctaatatgtgctgctgatagcaaacccatcttttgcctataatcacatactgtttgcatttgaaaataccaagctctgggtatactataatatttcattttgagtgtaaaatgtacgatcatgaaaattatctggagacacattattatgtgcattttcttgatcctacattcatttatcttcagacactgccttctgaaattcatagcctatttcatcatcattatttgccttacttgagaatttagtaacttgctgttggtggtttgaaaacagctggattttgttggtagcctttaactggcagttataaagaaaatattttattgatttctattcaattttattccatatgttatagcacaggtattgacattaatttgaaattgaatatgtatacataaaaaatataaaacaaaaacaatatacattacatataaatgaaaaatctaatttccctttttggaaaatgaaacagaagtcatccattaactaggaataaactgttcttccatcaaagtttatttactggtggttcctttctgtccctactgcatgtaaaaatgatcatttttgtgcatttcttcattttaggatgtctctcaaagctaaatattgtaaaatacattttctaacttatgtctttctaccctagatttctgaagccaaccacactatcaagtatttttaagaattccatgtgaaagtcaaaatgccatcatgatgcatacaatttaagtcaattgttctggcactatgaatgatcagtatgatcaccttgtaaaatacgaatgaaagtgctttggttttaccttcagagactcctcttgcttaaagagatcttcaaagtccttagcacagaggtcaggagcattgagaagttgttccacttctaatagggcttgtgagacatgagtgatttcagtcaaataagtagaaggcacataagaaatttccaaaggcatgtcttcagtcatcaccatcatcgtttcttcacggacagtgtgctggtatagatatacaaaagaacaattttttttagcttcctaacagtgaaacctcctccattaagtttatataggtctcattctacagctgacaattgaatctacaaactgggctgaaaatggattcaaaacctcacgatggtaagtctagtaaaacggtgatttattaattatatacctactttttccagaaagtgttaaaagcatttcataataagtgacacacacatattagcaccataaatataagacgaaagaccatgaggtcataaggagagtagttttatcctaagaaaaagacgatttttgcaaccggcatttaaatttctaattctaatttgcaactggcatttaaaattctaattttcctggaaatctagatatgggattgggtgagggggactcatatctgttttattcctaacacaggcaactttcctgtatctataggaaagttcactgagatacaacagatacgaagtagttaggctggtatgtaactttgtattaagccctcttctcctccaaattctagacattagctcctgtttttgttgctagtctcttgctaagttaagctgctaatgaagctgctatatgagcagaactgactgcggaatttatattttaaaaagaactccagaatgtcctgatatataagggagcactagcctcttctcttgcacctacacttttctgactgggatccaagtgctagacatgatgagaatttccagctccagagtccttttggagtttcccagtaatacatctttccctattctttataagagcaaaaaataaatactacttggcaggcaaattcagaaagatggatgacctgtgctctcttctgtctacactataggcagcaaaattcttgtaattgaaattattctcccaataactttgtctagaattgatcaactgccacctgcctgttgatgaggtcacctgagggtttcagtggtagggtctctggggaagtacaaacgataagcatgctaacgtagccatttattactgcacagccttttatgacaacaccatacttatttttgcagtaatgtaatacattggactttggggatactagactgaaccccacacaaagaggagtaaaatttacaagctggtcactttatgttttgtttttaatttctctgacctaggattttcatactcaattcttacatgatataaaaaatgaagtaattctaatttagatatctcatctacttgtgatatagcaaattcacagaattgcacaaattagctattaaataattataccttttacaacatttgttttattgtgtatatctgggccaaatccatggcacacattccttcatgttcaatggaataatgtatatatatttctcatttacatttaaaaggatattagaaacttgagccagagtttgataaataaaattcagaatttaacagatttcttaagaaattcttaatttcactatttcatcataagcattttacacatttaaaagaaaaataactcagcaggctatttgaatgtgaaattttcactgacacattaaacagtagaatcaatagcacaagtaacacaagcttgtgttttgcacgcattacattggttggtgaccattatgttgttcttaataaaatttacaagttaataagctcgtctttcttattcacgttagttgctataacccctgcagtaaagatagcttcacatcatctaaagcaagcgtatttcttataatacttatttaatggtgcaattaaatctgcctttaatgatacattttacacctgtaagtttttggaaaacaaaggtttttgttatcaggaacagagtaagtagaagacaagttgtagtttttcatttatttattaatttgttttgttgtttaatcaagggagttgtttcagaattggacatatcttgaaaatatttagaaaaaaatctgggtggccttaacaaaagcagtgggaattcagaaaagttttgatgcatgtcctcatcactttttcttaaaagaaaaataattctaagatgtttttatctattttctgattcttctttgatatgtagttttctcagtcttcattactttcatttgagatgctctcagctatcttaaattcatattggtgcttaataaatatagtaattgtggattatagccagcaagaaacttagctgtatggtcaaatataatgaagaaaaagacactcaaaatatactcacttttgtctgctaacttgtatttaacttccttaaatgaaatttcaaacccaaattttgactattttggtatttgcagaaaggaacgttaaataaaaatgagatttgccaatgaatccaggagctggtcttttgaaaagattaacaaaatagatagaccactagccagactaataaagaagaaaagagaaaagaatcaaagaggcacaataaaaaatgataaaggggatatcaccaccgatcccacagaaatacaaactaccatcagagaatactatcaacacctctacgcaaataaactagaaaatctagaaaaaatggataaattcctggacacatacaccctcccaagactaaaccaggaagaagttgaatccctgaatagaccaataacaagttctgaaattgaggcagtaatagcctacgaaccaaaaaaaaaaaaaaaaaaaaaagcccaggaccagacggattcacagctgaattctaccagagatacaaagaggagctggtaccattccctctaaaactattccaagcaatacaaaagaaaataaattcttccctaactctttttatgaggccagcagcatcctgataccaaaacctggcaaagacacaacaaaaaagaaaatcctcaataaaatactggcaaaccaaatccagtagcacattaaaaagcatatccatcacaatcaagtaggcttcatccctgggatgcaaagctggttcaacatacgcaaatcaataaatgtaacccatcacataaacagaaccaatgaccaaaaaaaccacatgattatctcaatagatgcagaaaaggtcttggataaattcaacaccctttcatgttaaaaacactcaataaactagttattgatgggacaaatctcaaaatattaagagctatttatgacaaacccacagccagtatcatactgaatgggcaaaagctagaagcattccctttgaaaactggcacaagacaaggatgccctctctcaccactcctattcaacatagtattggaagtcctggccagggcaatcaggcaagagaaagaaagaaagatattcaaataggaagagaggaagtcaaattatctctgtttgcagatgacatgattgtatatttagaaaaccccatcgtctcagcccaaaaactctttaagctgataagcaacttcagcaaagtctcaggatacaaaatcaacgtgcaaaaatcacaagcattcctataaaccaataacagacagagagccaaataatgagagaactcccattaaaaattgctacaaagagaataaaatacctaggaatacaacttgcaagggatgtgaagggcctcttcaaggagaactacaaaccactgctcaaggaaataagagaggacccaaacaaatggaaaaacattccatgcttatggaaaggaagaatcaataacatgaaaatggccatagcgcccaaagtaatttatagattcaatgctactcccatcaagctaccattgactttcttcacagaattagaacaaactactttacatttcatatggaaccaaaaaagggcccatatagccaagaaaatcctaagcaagaataacaaagctggaggcatcacgctacctgacttcaaactatactataatgctacagtaaccaaaacagattatactgatagcaaaacagatatatagaccaacggaacagaacagaggcctcagaaatatcaccacacatctacaaccatctgatctttgacaaacctgacaaaaacaagcaatgtggaaaagattccctatttaataaatggtgtcgggaaaactggctggccatatgcagaaaacggaaactagacccctttcttacaccttatacaaaaattaactcatgatggattaaagacttaaacctaagacctgaaaccataaaaactctagaagaaaacctaggcaataccattcaggatacaggcatgggcaaagacttcatgactaaaacaccaaaagcaacagcaacaaaagccaaaattgacaaatgggatctaattaaactgaagagcacagcaaaagaccctatcatgagagtcaacaggcaacctacagaatgagagaaaacttttgcaatctatccatctgacaaagggctattatccagaatctataaggaacttaaacaaatttacaagaaaaaaaagaccccatcagaaagtgggcaaaggatatgaacagacacttcgcaaaagaagacatttacgcggccaacaaacataagaaaaaaacctcatcatcactggtcattagagaaatgcaagtcaaaaccacaacgagatagcatctcacaccagttagaatggcgatcattaaaaagtcaggaaacaactgatgctggagaagatgtggagaaataggaactcttttacactgttggtgggagtgtaaattagttccaccattgtggaagacagtgtgcagattcctcaaggatctagaaccagaaataccatttgacccagcaatcccattactggatatatacccaaaggattataaatcatcctactataaagacacatgcacacgtatgtttattgcagcactgttcacaatagcaaagaattgcaaccaacccaaatgcccaccagtgatagactggataaagaaaattgacacatatacaccatgggacactatgcagccataaaaaagaatgagttcgtgtcctttgcaggaacatggatgaaactagaaaccgtcattctcagcaaactaacacaggaacagaaaaccaaacactgcatgttctcactgataatgggagttgaacaatgaaaacatatggccgcaggggcctgttggcgggtggggggcaaggggagggatagcattaggagaaatacctaatgtagatgacaggttgatgggtgcagcaaaccaccacggaacatgtatacctatgcaacaaacctgcacgttctgtacatgtatcccagaacttaagtataattaaaaaaaaaaagaaaaaatcattcagtgacactggataaaataaaaattagattcacttagaaaataataattcgtgctctcagaccagaattctgtgtctcagcaaataagatccagtgttaatcatagtcctaaaccagggcttaaagaatgtaggcagcacaccataccctggcttctcatctgttaagcttctctccacctgaccccatgtgtctaccatagattattatataccgatttaacaaatattcttcagaacattaaactaaaaaccattttcacctatctttcaaagaaaatctcttttagaagagtgttatgtggcatctatttaaattgccaatttttctggtaatcatccttttactctctgtacaagagttcaatttttaagaaaattttagatacctaagtgacaaataattgtaattctgtatctggttctagaaatcattttttacaaacttttaaataatgaagaagctcttattaacctgatcgaaatactcttaaaagaaatattagccattgaactgcaggttgagaatgctctaataatatgcatattgtgattattttcaagattgtcacaaataagccatagagcaaccagtgtcaatacatggaaataatccctacatgctcagccatggcatgaacacattttctagaacacttagaaatattaaaattcttatggttgaacataatcaataaaaaggtatagtttattactttagaaaaatctgaatgagaaaaatcatttctatcctcaactactgataattaagtaatctttcaaaaatttttctttccattataaagataaattagaatacctgtaatttctaagatgcttctcattacaattacctatgggcaacagttcagctatacgttataaagtctaaaaggttaatgttatactttaaatatatttaatgaagacggatctattgaaagatttactatcttgatacgtagtgtccagtcatcacagataacagacactaagtggtacagatcagctgactagagaaaactaagggttgatcctgtgaactttcttgagaaatagaaatattccaaaataactttttgacaccactgggaaactgtgaactcattttctagaaaattccgtgttattaagtttgaatattctcatttattatagcaatctgatatatacaataatgtttaatatatagacttttttgtaattttcatatacaagaaactaccagaaattgaatcaaaagagaaccagacatttggagatctagtttgctatctattccttaaaagtatagcattcctattgacacagtcatgcgaatctataatgagaaaactacatccattgaatgactttcagtttggtttaataaaaatttcagacagttatttaaaaatcagtgtaattagaaatatcatgttcattttctcttctttatgcaaaatccaggtactcattcagattaatccttttcatttgaatttcattaactctgccttgaataattttatccttctgagttctgatgtgtacaaatcccgtctaaccttttgaaaatcaacttgcttttgttaatgttctttaccaccttatatcattatagatactcatgcatcattagcaaggaaatgctataatctgattaattcattttatttctttgtgtttattttcatttttaaccatatataccccaaagaatatactagcctcattttctagaaacaaaaagatatgtgaaagaaaccataaaatgcctatttttatttaaaaatgaaaagttcgatcaatgcttaatgactattatagaacacaattatgatttgtatgatctaaacttaaagtcaaaacagttttaagattctgagctgtgtaaataggcacaggtatcactcacaaagttttgaatacattttcattcatctgaaacttaagttatcacattcttttcattacataaaatttgtttcttgaagggccataactgcaaaggataaaagcaatcctgttttgaaacaaatggtgcattatgtctaggtttttaaacaaaatgttttcctccatgatttaaaagacttctttctcctttaaatgcattgaggttactggcccatttatgagttatgaggtcaaagaaactcaagaagaaaaatgtgctatatgacatatgattatgacatatgccacaaaataactatatatctcatataaatatggcacatgaaaaatatatcaatgcatcaaaagtgtaacaaaaatagactattatcttgaccaaaaacagtaaaatagtgatggagcctttttttttttaactgcgttggtgttaatgaagatgaaaataagcaaatcctcaaagtaagatttattaatgatttagtgtgagctataatatgaaaatctatgagccataatatgaaagtatgtcagtttgtatctgattatctttcctcaaagggacattcttaaatattatggattatttaaaagtaataacacaatgatatgtaaatccaaaataggactgcaggctttaagtaggttctgatgggtcataaatgaaaaggcaatgggaaagacttaagtcttagacaagtagctctgtctcttagccccacaagtcttcagagaaagacaagtttccttctaggaatcattacagtaataaacaaagttgagagattttttatttatttctcctggacaattataataggcattgtaagcataaaaatgcaaatcacaaacaaattaggcaaaaatattgtattggtccagggtgattaaaaaaccccaaacaataaagcataaaaacaaaacaacatgatgcaggtgagacgggtatggttttaatctgcgttgtcactgttttggatacatataatggcatgacaataacagcattctgacagtacttcgttttgtctgttttagtcaagtcactgggtagaaagatgttgaataatcaatctaatgagtctaagcatattggttatgaccgtgcatagaaaaaatagcaatgagagagtgtttgctcttatgtgatttcccccttcctattgcatcatctaaaaaattgcttatgtgaagctatgtaaccaaaaaaagggcctgtccatctcagaataattattcagaatcaatgaacaatttaccccctttgtttaaaaagaataaaactcactaacatacacaaaatagtcaaggtaaaatatgaaagaaaatcatcctttatgcccatattatttattttctaaagttagaattaatttttaaagcagggcaggctgtcagcgaaaaagatatgcagatgatgctggatttgccagtctttaaatacaccctgcttctagaaggccaggtataaatagtgtcctatgtaaaaggtctggacagacctgctcattgacctgcctcatgtggattctgactttctacaccatgaaatttacctaattcctcagggccaagctcaattactatcaaattaagctgataaactgaatctggaaaatgtgttaatggcttatagtggtttaaagtctttcgtttcaaaggacaacatttgcatttttatacagattttcaaagaattaacataaattagtaacttgataaaattttagtcactaagtatggcctgtgagagaagagaaagaaaagggctttggttgccaccaagataagtatcaacacataagcagcaatatataagcaccaacaatcatggcctgctttgtaaaaccatctccaaaaaataacctataaattaatagataaggttatacaccctagccaacttataaggcagcaaaaaataaatgcagcaaagactcatgcctagtacctagcatacagtatgttatcaaaaatatttgttggataaattaatgaaaaaacaagtatcaacttaacaggataattataagatagatatgtggttacaattgctgggatttacatttataatttatatttaggaatattcagaattcaaacaggaatattttcttcattttataatgcaatctttattgtcatagatttaaaaggtatatctgatttcactatgtcgcatttcttcaattcatagcacattagctacatgctattgtacatgcgtgcttaggtccttaaattgtcttttagttactaatctgactcattatacttgaatacaaacataagcaattatttgaggtaatgacatatagacgatattaagatatactgattttagcttcttcatgggtatcataatgtctattagcaaattgaagggtatgagaagacttgtattcaaaaaatcattttaacctttgataactcttcccaaactcttctcataaaagttttcgtttacatatctagtatatattttttattttaagctattccaaaatttcagcttgggaatacttgctatagcaatctttttgtatgttgacaagcaaatcgaaccctccctccacctcacacacatacttatacttaattcagtgtgaaaataaaagtaacacaagaaaaaataagtatggaaagaccttaaatactgcagttatatttcaccctcctatatcgcttttaacttctgttgccttgtggatctgtcaacttgagtagatttttcagaataaactcacacttttatttctatattacatttgtcacacccctcagaaaatgtggacactatctctagattaatgcggcaactcagtatctatgtctaaatatgcatgtgtcataattatgtttttcaaggaagtattctcttcattagaaatgcgagtgatagtaaagatgcatataattacactatcccgtatggtagtcattagctacacttgacgaaagaaatgtaaatctaaattatttaaaagcaaatacaattaaaaacttagtacatctgtttttactagccatgttttaagttctcagtagcctcaatagctactttattggacagtgtagatatagaacattgccatcatctcagaaagttctataggacagtgctaatctagagaatgacaatacattttatttatagaaaaggttaataccaaagtatgttctgtaatcgttttttattctactcagtctctgtccaaagggctgtctagtacttaatgtggttaaagttacctaatgagcactcaattaatattcttttataatggcaatcatacaagaaagaaagatttgtttctttttcaaattgcttattaaaatataacaatgtgttctattttaaataatgtgaaaactaagattatatgaataattctaatgctggtattatatctatcagaaaatacttgtagcctagttttttcacaaaggtaatttagacaggctactaaatccaaactaaaatgtcacaaggtgaaaactcaactaatttgttattattctatatccaattgattttactgaattgctaatacactgtattttgttttcaggtagacacagcctaaatctgtaagtaatctcactcaactctgaagataattaatttaaaaacctattattgtgaattatacataatttgcattatttatatggtcaaagcttattaattatatatatgcacatgtatgtatgtacgtgtctgtgcaaatacagacacacaaaatagaaatgttgagaatgggtaaatcacatcgtagatatgttttctgtttcactttgaactgagtccatgcaacgtcaagataatcacaactaactgctacaatttagaagaatatatgtatcaggacctcaaattatggaaaaaaaaattgcaggtgaagagagaatgatgatgaactggtgatatttcaaagttatgtgtatcttggcacgatctgagacagaaatgatggatctgatggttttcaagtatatatgtggaatgatctgttggagaccattgatttaaggagatctgtttgacttaagaagggggtcagtacctgctagtttgtttcatgcaggcattactggagagtggctgtactacatggttgaggacagccttacttccaccccttgtccatgagatcagagatgttttcccatatgtaaattttgtgaataggtttcagcttgttaaataattattcatcagatcaaaacaacaacaacaacaacaaaacttccagtatccatgttgcttctcaatcaatcactatgcatcaaaatatcaaaaccttaactgcatttgcgccaagacattttacattctttgacttaggcatgagagaaaataaagcaaaggctttttcagaagacacaaggggctggagagaaagacaaagctgagagtccatacaagtagtatactagaagatacggaaggtacatttaataaaaataaaattagaaacattaaaaggttaacattagagcacagaaagcctgttacctagtttttaaataacaatagacaacttagaaaagagaatgatcatggctaaaaataaaatatgggttctttacagtcaaccagaagaagtatatcacaatttaaagacaaatagaaataaactgacattaatagtgaaaaaataagagacttagagaacagatctaagatacctattaagcaatgataagtaccagaatgagaaaaaagaagagatggaagatttgtaataattaaaacaatcataatagaaaattttccagagctaaagaagttattaatattaattggttatttaaaacgttacccaagtgcaaaaaagaattaaataagtggtgggtcacaactgaaatcccagcactttaggaggctgaggtgagaagattacttgattccaggagttcaagaccagcctgggcaacataatgacacatcatctctacaaacaaatgttttaaaaattagccagtcatggtactgatggcctgtagtcccagccactaaagaggctgaggcaataggatctcctgagcctaggagttggtggctgcagtgagctatgattgcatcgcggcactccagcttgggcaatagcaagaccctgtctcaaaaataaaaacaaaataaaataaaataaaataataaacagggacacatttagaaacatttaaaattatatcttaatgaaatttctgtacttcaatagatgggacagacagcaactttagagtttgagagaaagaaaaaaggttaaatacaaataaatgatacttggactagaatcagactttacactggaaacaatagtagcttgaagatagttgaaacaagaaaacaatggaaactggaagacaattgttcataacctacagagactactaaaaaaagaggagagatattaaagaatgttactatccaataaatccatcatgatgactgcaaagcaaagatcatttcgaaaatgcaaggtttacaaagtttacatcctttatgtttttacgaggacatttctcatgtgttccaaccaaattaaaactgaagtacagttggccctctgtatccatgggttccacatttgtggatttaaccagtcatcgatcgaacacatttgcaaaaatacatggatggctgtgtctgcactgaacatgtacagacatttttattgccattattccctaaacaatactgcataacaactatttacatagcatttacattgtattgggtactataaataatctagagatgatatgaagtgttcaggagggtgtccatagttacatgcaaacactatgccattttatataaataatttgagtattcttgaattttgatatcaaaatgctgaaaccagtgccccacagacactgaaggatgactgtgtaataaagatttcaaaacaatgagaaataaacggtacaaaaaaacagtgacaggaaatacaccttgtgtcgtttgtggtcaaattttatgaagtgatagtgtaatttaagtaataacatgacatcttgaactagtatgtgatactacaagtgaaaacaatagtagccaggaaataaaattataaattatttctttttaaaggattttgcctttgattgaaaataatgaggagttgactaagtaaatcatcttggtgatgagggcattgttcttatttaattttggcgcaacactacagaaatataggcataaaattgttgtttaaaatgggaaacagcactagtaaaatgatagtacaaagtataacttataaataacctataagtgcgggaagagatgcagtagagtgcagtgaagaagatgatgaattataaaattatagacaagggataagagtaaataaaatgataaaataatgaccatcaatatgacaaggaattaaaacagacacagttataagagttattgtaaaaatgaagttggttaaaatgtctcatctaaagatgaactatctatcatttttatatcttcataagatcaagcacgtattggtaagaatatgtgatttttttttatagataccagaggctgggaagagtgtaggtgggcggaatgggtgaagagagattggttactgggtacggacatacagttgcatagaaagagtaagtgctaatgtttgaaagaagagtagggtgactataatcaacaatatattgtatctctcaaaatacctagaagagaggagttgaactatttccaacacatataaatgataaatacttgagatgatggataccctaactatcctgacttaatcattatacattctatgcatgtagcaaaatattacatgtaccctataaagatgtaaaaatatttgcataagttaaaaagacaaaattatctagtttaaaatgcacactccatctataggctgtttacaagaaacataaaaatacaaggtcacaatgctgcgttaatggtgatttagaaaaccattttttaaaaagtgaaagtcacaagaaacataaaaatacaaggtcacaatgctgcgttaatggtgatttagaaaaccattttttaaaaagtgaaagtcaaaataatagcatcaaatgaagtatagttcaagaccgaaaagcactaaatgggtctcagagaaccattgtaatgacaaaaatcacacttcttcccaaagcacagtagtcattaattgctatgccccaaacaattgggtgcattctacataaggtaaaaattactagaaataaaaggagaacatgataaaatcatagctgtagttggtaccttacatacaactcttctgtaatttgttagattaaaatagacaaaaaatacaaataaaaaacaagaatagaggtggtttaaaaccgacaagctaaatttaatccgtattttgtgcacactggaaaaagcatattctcctatttacttgggacatcaaaaattacatagagaggaaacttttaaaagcatcaaaaagaaagatttgataggccaccttttctaatcaaaatataataatccagaaatgtagaagaataatagaatacattttgattcatcatctaagactttcacaaagaatgtataagatctatatacattacctgggaacatgtttctaattgactgttatatttaaaataatacacagaataaagcagtattttttaaaaaagtaaaatatatctatatatactattcattggtaagaatgaacagtatatggaatatagtacaaagagatatctaagactaaactatagactttttaaagactaaattgtagactttttttttgcttcagtgagggaggaatcagcagaatgaagaaatgaagagtagtaaagtttccttaatctacctttgtattaattgattaaagtaatactgcaatacatttaaaataatcgcacagagctctgaactagcactaaagagtagatgcaaatagatacagatttcaaggtaaattgagtctttacataacatatttatcagtaggcatggccccctctaattgactttattgttcataatagacttcacttctattcaagctgcaggaaggcatgtactactaattggctcccaatattatggaagcatagactaagacaaaattcagaagggagaatgaaagcattttgaaacaatttcacatcatcacctaaaaccatattggtgcccctcactgcatacccaattgacagaagagtcgtggcaaagactagtggctgctgttgcccatgaagtaaagagaattatttttaggtgcctgagattcctggagatgaggaaatttaacagccaatggctaatagcactcttatgtgacagcatccaatactcgatatattttaattgatcttaagtactcaattttttttttttttttttttgagacggagtctcgctctgttgcccaggctggagtgcagtggcttgatctcggctcactgcaaactacacttcccaggttcaatttataagcaactaattaaataagtatcactaatgagaaaaatacccaagccaaagtaaacatttagctaaggatattgtaatccataaaaatacaactttttgtttgcatttgaaatgactgcttcaattctccccatgtatttgaagtcactttgctaagctgaaaagttttcctctttggcctggcacattagaccatctttatttccatgcccttaacttgaagggacactaatgacattgtgatatactgataacagtatttacaaaattatctgacctaattccaaataacaagtttgagagttaccctgcattctattcttctttgaaatatgcacaacaatttcatatacctgcaataaaaagcaggcagttaaaaaaacacaactttaggaactcgactaaaagatggagaataacctacaaaaatcataatcttgatgagttcagcaggcatttttttcaaagccaaaggacatattttgctaagtaacttaatagatgtaaatagcaaataacatatagcatagctacataaataagcatatgtgtaacatatatgaatacatttatgtgtgcctatgcagcctcagatgtaaatatagagatataagttagctggtggcagtggtatgtgatttaggaagctaatatgccatatggcattatgtattaaacacttttgcacataggtaagatattaaagatccttgggctgggcgccatggctcacaccagtaatcccagcactttgggaggccgaggcaggcagatcatttgaggtcaggagttcaagacaagcctggacaacatggtgaaaccctgtctgtactaaaaaaataaaaaaattagccaggcgtgatggcggttgcctgtaatcccagcaactctggaggttgaggcaggagaatcacttgaacctgggagacagagggtgcagtgagccgagatcatgccactgcactccagcctgggtgacagggtgagaatctgtctcaaaaaaaaaaaaaaagtatttacctaactatatgaataaactattgaaataattaaattatccataagtataaaatgaaataaacactaattatctgttctctctctctgtctcccttcctccatccctccctctctcatctgtgttgccctgtgctaaattatttccccaaactatgagtccatatatataggttctttttcaccttactcgaggctgcagctattatctcctgtttcagtcatttattccttctgtcccattttgacttcaaagctactaggggcacaaaaaaaaaaagagataattaagtttattagaattacctctttaatcaaagcaaaatttttaaaaaatctccaaaaaaggatttggaaattcatttcataatgaaatataagtaagctttggatttcatgaaccttaaaaaatcaattttgggaatcgagaggccttttgttctactccattcctgactcttggctgtgttgcaggtaaattaaaatgatatccatctgacctctgaataaataaagtgccactgtgtgtatagaaatggttatatttaatattattttcccaaaataatatattttgccaggttataactttgcaaaatatggtaatagtcactgaagaaaaccatttttctcttaccaaagattacgctcaattcttttttaaaagttttgtgaatttaatgacaccttaggcttaatgtgctctactttacaatccagatagtttctcctaaaatagcttgttctctgtcaatgttccaggaaataatagtcattgtattatcctatggcaaggattccaatataaaattgttctattctgtccagaaaatttacaagttttaactctaaaaactcatattgacacaatcaattttcactccattttagatcatatattttgaaaaggtaattaactgagaacttggatatgactgttcctccccacaatctccttgtaaaagcagctacaacagaaataaagtattttaccaaataaaaaataaattttttttcacttctcaaaacttttcagaatacaaatttaattggcttatattatatccagaccaattatttcttaaataataattaactaaaatgatgaacgttagagtcttttgtcaatcacaaataattatgttaattattagtcattatgatcactgggaaataaagaatgtgaaaaaagcatgcataataacattaacgcattttgttaagtttttgatcttgatgcattgtttacaattatgaaaaggacagaaaatgtaatacttctgttttgaattaatttttggattccaaatatcatcaggaaatgatactattatgagttctttatatcaccaaaacaaacaaaaacagattcaaatccagaggatgaaaatatttatacacaagaaaataccattttggtacctttattatttgtaagtgttaacgttgaacaatgttagacaaatgtcgtgataccctaattctactcttttttgtgtattttgtcttgtttttgctcctcacatgtgacaaaataaattcaagaatgttattccagtggataactgttatggggccagtactgcttgccgaacaggccatacatataggaggtgatggttttcatgctttctcttcctcattctgaaacttcaagcaaccaatatagaaacttagcaggaatggtattccttcatgtaaataaatttatctaagttggtggtttacggacattgtatttcataggtcaataacaacattacaaaaaaaaaaaactattagggaacatcacaaaagttctgccctttactttttctagtaaaggacattgtaacaaaatgagaagaaagaaaaagaaaggccattttaatacctccaaaactgttgaaacccataattttgaaagaaaggacaattcttgcattaaaaaactttgctttatgaaaagctaaataaaaaattgctcttttttttcttttccttatggaccattgaaaacttctggaccatggcagactggcattaggataccactgacataaaaatacagaacaaccaactctgaaactgcagggatttccacaggaagatgttatacattcattcattcaatcattcattccacatactttcattaaatacctgctctgtgatagactctatgtcttggggaaacagtgactaacaagatagaataggctcctgacttcatcaagcctacattctaatgatagcagacaaattataaacaagtaaacatgcaaaggtaacatttgcagattgcagtaaatattagaagggaaacgtctagctgatgttctagagcatgatggtaaggatagaatggatgtggcgaacgacataaaataggttgtcgaaggcaggccacctgtggagataatgttcactctgcatcctgcaatgtgacgggagaccagcaaggaaatatccagaaatagaggcccaagtcaaaggaaacataattgcaatgacctgaggtagaagacatcttggcaagtttaaagaagaggagggctttgtagcagattaaagagaccctttcccattagggaggccaatatatgaagaggactagatctcttaattttccacatatgaaatactcgagtgtatctacgaagcaagaaatgaaaatatagtgaccgatattattcatgtttcatgtgtgtttatgattgtctagatactaaccagttaacacattttgagctttatacgggtcacagatggagttatatgttatagataactgtatttgttaggtaattcatttatttttcatcacccagatagtctattaactaagaaagcactaattattatggaaaattatggaccttctggaactttccccagttaatttattctggcgagaagtgcccatgcactgatatccagaaaaacagttaacaatgcctccaaattatctgaacatcttaagtttgtacagatatgggcacttggattatatttaatccatgcatctttcatccatggattagtcaccactaaatatagctttcctctgttttacatgcgttaaaatagctatttaggaattttaaaaactgctcatgattatagcatatggtgctaaatttgagaatgcaatcaattcggacttccatttagttctcttggctgttactaaatgggtgctaaactatactcaaaagattaaataaagggtaaaaatgatagaatgtttttaagcaaaattatgttataacatcaaggctatgtgaatttgtattattcataaaactaaattttaaacaaaccttaattatttcaaaagcaactggatcataaaggagggcaggagaattatcagataacttaccaacttgaaaatattataatccttttattttgtgaaaatcaaagtggaaaacaatatacacttgaatagattttattcatctgttctcagaatatgttccatacaatgagagtcttaagtaatcattgaagaatcagaatgattcacagatggtgcaagtgatttaattatttttaaccagttgttctggacatgctcagaaggatatttccaaccccactgcagaagccatctgagctcccttccagctggtgttccatattttcaaagcaaatttagattggagaaaattacactttatattgttgtgttgcaaacggaggtcaaattgctgtgtataaattcttgttcttttttttcttcattgtatgagttatatttatcaaatatcacgtcttttgtatgattgctatggatttgccaatggtattttacgttttgtgttgtctggcacttaggaggcactagataaatgtttattcaatgaaagaaataccaattcagtgtattcaaaataaaacttgaatttatttctagactcacactaagtgtatggagttaccatttaactgcatcctcaccattattgggaggttcccattaaaaatgaacaaaaaaaggaagaaaccaatgtaataaaacaataccacgatcactacccccatcatcaaagaaaatcatcaacaaaactctgtgttaattcaataagtaaaactacatcttgatgctggaaccctgtcccctaattttataggatcttaggaaacctgcttgacaaattttcacctttttaggctatcataaggataagagataccctttgtaaaaatttagtcttgcatacttcataatgcggaatgactgtaacatcagtcaagaaacataactgatatctgtaatcatttccactatgctaagaaaagggaatggaaggaatatgggcatcccattaatgtccatagtcacaatgagaagtaacaaactgttcccaaatagttctatcaaatgtaataatttttcaaggttgtagcattcaaataaagataatactaactttagtgaaccaagtttcctcatctgatgctaaaaatgagttatatttttttaattttatcagtaacattatatgatagtaaaactgcacatatcaataattcatcacttcattttgtatttatatccaatatttctgaaaaatatattaatcatagattttgcagtcaatatttcctgaagaatgtgctaaatttccacttgatagaaaaatttgacacagtatattactatgttttttcttatgtttattaatatatttgacaacacattgcatgatgactgtagtctattactgtaacattaattcagaagataagcaaatataaaattgtatatctaacagagccataatctaactataaaataattgtgaatagtaagtgtagcttgacacatttattctactatttttatttaacgtgctacttgaagccagtcatttgagacaatattcaagaggtaatatgttgtataaatcacgtataaatggtaaatttgcttaaacttacaagaatattaaactgtaattaacatcttattttatacatagtgatggctttggactagagatattcggaaaacacaaaatcctatgttcatatagtttcttactacccttgatgaattcaattaatgttcttaaacctcagttttctatttggattatttgctttaacttaatagcttgtctttatttttccctctactattcaaaaattgtatacttctatcgatttaatgattagtataaaattcttaacacgcacaagaaattttgcaagttttcattctaagcactaagagaatcttaaaattgctttattcattattgattaattacttattttatgaattaaacaaatatatactgtgtacctagtcactgttttgggtgttgaggacacagcagtgggaaaaaaagacaatttttttttgcattgttgggttggagctctacttctaggtagggaaataaatactcaagaagataaagaaggaaaatattgagaactttcctggtcatgcactttattgagaaaaataaatgaggaaagcatggataaaaagtgtgtgtgtgtgtgtgtgtgtgtgtgtgtggtgtatgtgcacacatgagaaagattcattgaaaaaaacacttttgagtaaagaagttaaggcagaaacgaaaagagccacatggagaaacgggggaggattattttaggcagaggtagcacacaatgcaatgggtgcatgtcagatctgtgaaagcagcagcaaaggggtcaacataggtggagcagaggaaagtattaagagataaggcctgagttaagaagtgggccagccaggtcagatatcccttgaaattcatgaagagttttggatttcacttaaaaatagatgggaattcattgaaggattatgatcagatttaaatatggtttatatttttcaaatgttgtccctgtgtattgtgtagagataggctaaagaaagcatgcgtagatttttttttttctctgaaaatttgaaagaacggtgcttccactgcatttgaggggaaaagaataattttgttttaatcaagtcacgaggctggatgaaaacagcaagacatatatagaataaataaaaatggcaagtgcccaaggactgagcactgaggcatttcagcattagagaagtaggtactacctatggaaactgagaaacaatacatagaaaggtagcaggtaaactggatgaaaaacttaaccaccttctcatgtttcattgatgtccagcatttttctgttttttaatagacactttcatacacggtaaatgtttatttaagacttttccatttttttaccattttctttgcacatcattttcttttgcagcttaaatcttccatcttgtatctttctcctgcttaaagaccaatcttgacgtcctctaaagggaattttatgctagtaaacggtttctgtgtgtctgaaaagatctttatttcaatgttattcctgaaagagagtttctatcagtacacaattctaggttcctacgtggatgttctttcattgtttttgaaaatattattctaccgtcttctggcttctatcattgctctaaaaccaggtaccattttaagtgtcactactttctaaggaaatacagcagtatttaaaattatttctttgctttttttggattcatcagattcatcgtctcatagtgatgatctatacttatatttcttttttttaataatcttttctgcttcagatttgctcagtttcccaatcggagtattggaatttctattaagttttgaaaatcctaagctattatcactacagataatgcctcttctccattgtgggtaggatttatttattcccctttacagctgagggaagcccttgaaaattcagactttaaggaggggttttattttcacctctatattatgtgttgttgaaggtcacatattttgtcctaaaaggtcttgaaaacttcttcctagccattaggctctcaatccaggttcagtttcacgtaagatgatttgatcattcatggcacacagagggaagagaggttccaccatagcccagctgtgtatttaaaacttttaaaaattatattttattcagaatttccacgcatttgaagtgagggggtgaggaattaagtcagtctgtcatctttctggaagctgatactcgctgaacatgcctctacttaaccattaaactgattatgctacacaactagacactagaacaaaaaaactccgtacaaatatttataaccactatgatcatcaacaatctagaaaaacataaaatgttagctaatttcttttttaatccttgtaatatgttaattacaaaattgagctgagaggagaaaaattctacaaacagctacatcctggtgcaacatttcccttaacaaccattattagtcttttgtatttacaattccatttgctaaagaacattctgtctctaaataagaaaatcatttatcttcccaaattctccaaggatgttgcactggcagctgacaatctttgttgttatttcaaggcaaagaagaaaatctatgtggcaattatgcaaagacaatatatttcccctaattttattctcaaaatgagttgcttttattacaagataggagacaatataaaaaatgtgtagcagaccattaaatctaggctcagacattattttacataaggtggtggcaaacagttctgttattacttttcttgtacatctctgcttaaatttaaggaaatcccaaacaacagaagaataatgatacggtgatgttcttcccatttttttctaaagaatattcttatttcaccatcactcaaataagaaacctttcatcaatctgaaatcaaatttcccttttctactgcaactgtctagatgtgaaagtctatagaatctaaccccttcatagaaagtcataatcccattagcatatcaaacgcactagaaagttatagagtaaggaaagtttgcttaatctactgtttaccaaaattgtttaaacactgaaacttttttccttttttattaataactcccaccatgttttggaaagcagtgagttcaagtttggcgtcttccatttctcagatgtatccttggacaaatctcttaacctcatttatgctaatttttcttacagtaaaatgacaaagaaaatgatacttgagagggtcattactgtgatcaaactagatgcatgtgaaaactctttgtgaatgtataatactattcagattcaaacaacttaaaaaagttagtggaaaaatattcacaatatataggtgtttattttacaaatttattcaattaaggactacttttttttcttgaggcggggtctcaatctgttgcccaggctgtagtgcagtggtgtgatccctgctgactgtaacctctgtctcccagtttcaagcaattctcatgcctcagcctctgagaagcttggattacaagcaactgccagcaagcctggctaattttatatataaaacatatataatacatatatataacatatatatataacttgtatatatatgttatatatggatgtatatatgtatatacatgtatatataacatgtatttataacatttatatatacatgttatatatataacatgtgtatgttatatataaaacatgttatatataacgtgtatatgttatataacatgttatatacataacatgtgtatgttatatataaaacattataaaacaaacatgttatatacataacatatacataacatgttatatacataacatatacataatatgtatatataacatataacatgttatatacataacatgtatatataacatgtatatacgtagaacatgtgtatataggcataacatgtatatataaaacgttatatatgtataacatgttatatataacacgtgtatatatgtataacatgttatatataacgtgcatatataacatgttatattcaacgttatatgtgtataacatgttatatataacatgttatacatataacgtgtatatatgtatgttatatataacgtgtatacgtgtatgttatatataacgtgtatatgtgtataacatgttatatataacgtgtatatataacgttatatataacgtgtatatataacgttatatataacgtgtatatataacgttatatataacgtgtgtataacatgttatatataacgtgtgtatacgtacatgttatatatgttatatgtaacatgtgcatacgtgtataacatgttatctgtgtgtgtataacatgtgtatatatgtatagcatgtcatatatatacatgacatgttatatatgttagccaggctgatctggaactcctcctcaagtgatccgcccacctcggcctcacaaagagctgggattacagttgtgagccaccacgcccagccaaggactattttaaataacacatttattgcagcatttaatctacaaacaaggttaattttctatcagccttccaagagcatgtatattttggaaatgtgtactttaattttgtcaaaatatcccattacaattactctgctgtaggacaagctatccattgcaatacaatattgtaaccctcttcatattcatcttttaccacctcacttttatgttccagaagctgtgtctttccttagtatgcctacttctagaagtaaccgtaagagaaactgatgttctgaacgagcagtcttaaactccgaatttgcatacataagtatagggaatataaaacatttataacagaaactactacattacataaccagattatacatcaaagttctactaaatattcattgttcctaaatgaaaggatatctaaataagttatagcacctatgcaaaattctaggtgaaaaatattccattagaaaaatatgttcaaagatactgatatggaaatgaaattggttgtgtttaagtatagaaaagaaacctttaggcctctatgttagcagaagagcaaaaagggagacaaagtgtgagtaacagaagtgataggaaggggctacatcatatagcggatcacaggatttcatttaaagagtaatgggcaggaggggcctgatatgatctcattaactccttagaaggagctctctgccttcaccaggagaaatatggtgtaagtggggaaagactggaagaagaggttagaggttgttgaagtaatccagatgagagataataatcttgtagattagcacttccataacagatacggaggagtgatttgatgcattttgcaggtatatccaacaagagtggaaataatttacatggtaatgtaagagaaaagaatcatgaaggatgtctaggtttctgacttaagtaaataatagtgcaatttaataacatctggagatgttggtagatgccaattaacgtagatggggggtggatcatttatttttcacttggctattgtatgtttgagatgctcattaggcatccaagataagagactgttggatataaaatgttaaacatcaagatcatatacttggtatttgatgtcataacatgctcagctcaagtggaaatgtatttagaaaatggacatttctttttcttcactgaagtgggcttttttttgtatttttttgctgctgttcttggaaaggtcatgtatgtatacatatttcagaggtttagcacttttttgctatctagaaacattataattggtaataatttacatagaacacattatgcacaagccttatatttgttgccattatctcgaataagtcttgtttttatctccctttacatagcatatgtaatatgcaggatatgaattaaggatatgtaattcataggatatgcaataagtcttctatttgatttctctctctttacacaggatcagtcaaacactgcattctcctagtattctgtgttttccttggtggcactgaccaaattttaggattataagcttttttaataaatgttcttatttacagagaaaacaattttatacagctttacatcgctgtctccttccttctagtttcattttattttacacaaatatattgcttagtaattattttagcaaaaatctatagacaagaaattcttagtttttgttcaggtgaaactagctgtatgtctgagaatattttgccttaattcttgaatcatgttttacctggtatttgaaaatgtgcctagcattttgaagatattattcaactgtcttctaatatctattgttgatgaaaagtcttcagtcaatattgtcatcctgtaaatgttcttttgtcttaagtaacccttaatgatacctttttgattactgatgctctgagtttcattcagagctagctggtagacttgtttttattttttccacgttggttgacctttattgaatttgaggattcattaaaatttacatttattccattttattaaatttcattaatatgaaatattgtctcttccccataatccctatttttttcaacttgaaacttatttcacgcagatgtttgagggattaattatattttcatttccagactttgttttttcaaatcttcgttttcactttatataatggcctattcttactggaaaaaaatccatttaatttttatttttgaacattaaaaattacttaatatcctttggtgattatcctcttatctctattttcttcaggtatacattctccttttaacgtttggcatctgataacattgcttataatttttttccacaataatcataattttagtttgtaagcttatgttccttagcagtttcacatgacccttgggggttgtagtggtatcttcattgtataattttgtgtttgcaaatgcctgggctctctgaggttattttccaaatgctacaatgatgtgaggggcagtttagggaaaatcatgccctttcttggcagtcatcagatttgtgtgatatttcctgtgtttattctgtgaatctagagaaaagtatctgcttatatattatagaattaaatttgaaattttcactgaacgagatatctgttgttaacattttaaacaaatgctgcgtacttaattctcttaatgacttatgaaaatattttaaaaattaaagattatgtctattttccaatgttaatatatatacagaaaggagacgaagaaaactttcatgcattgagcctgcataacgcagcaggtgtttgacaaatattaccttatttaatcctcagaaacatccttatctctattgtacagatgaagtaaatgagactcagtttatccctgatcatacagcactcaaagtcactgggattcatattcaaggctgtttatccaagagttaattttactagaccacactgctgtgatagtacatcctatagaactatcccttttcctcagtttacagtccgtgcttggtcttaactgaggaacctagtttctaaaccaacaggaaatatattagaaatgattggaattcctaattaaggcaggagttctctcattttgaatatctggtaaaatttttacctgcgtcctcccagtctcatgcctctttctttatcatctccaggtttgccctgaggaccacaatttgcagataccctctactatgctttggtctgcattcctgtgtggctgggcgctgcctcatgattgttccctcaaagtctcagtccttttctgagctttattactaccatatatagctctgacatggacagagtcccctaaatgccttaattttacagtggttagcacttctctgagtctttatctgtgagataaggaaaattaatttttcattttaaactcactcagctctcacatactaagcattttaagagtaccgcttactatttcaacatgttgctgtaaagacatgaaagatgaactttaagcctacagtttatatctagaaaaacaaaaagggacagttaggaaaagtaaaaatcaaacaattagagaaggagaatatagggggaggtaagaaattctgaagctatggcatatgctgcatcagagccattgtaaggttatatcaaatactacttttcattaagctgttactgtgactatcacaaatgactctagggcgtaagaattgggaaagataactctaatcagtggccacagtgaaattagttttaaaatgcattgacaattggtcaagtataaagatgtatcttgaatatttctacacccacctgtctatctatctacctaccaacctatatacctacttatcatctatcaattatccctcagttctaattaaaatacgatgccaaatataactgcaatattaaattgattattcttcatacagattgtgattactttattatcatggataattaagagttaacacaaaaatagcccccttcacattctgaattttggatctttaatatataaaacttaagaataaatcgtttatgaggaaaatatatcccagaattttactacaattttttaaaaatatatactggttcacacatgcttcctttatttcaccagtcattattacgttgtacaaatatttgttgagagcctactatgaatagggacataatggcattttaagtaagtggtttatggagatttttgatcctgtgcctatttagccataaagcattagcaacttgattagtttgtaacgaattttaaacctgcatattgggtgtgtcaagacctggggaaaattggaatggagaaatgagttagtagtcagataattcaaagcaaaggactcccccttgaatgatctattaaattgaggtgaaactattttattagaattttctttttgattgccttaatctttcgcttcattttgcatctgcagacacaggcttgctggttagtgtaaggttatttatgacacattacattcataacatctaatatgaaggataataggctgaaacattcagccaggtggaattagacttcacatgcaatacagtttcgctatttctcgtattcttccaattgctcagaataattcacctgctattaaactttagggtattagatttaacagaaaacagtgtatttattaattttcttgaagtattaaaagaagtcacaataatatgcaacatacttcccttatatgcttataaaattaagttatggtaactgcttttgacattttaaaaatatacaccaaattaaatggaactgacactatcacagaagaagttcccaagaagtctcatacatgggctgaaccctatgcagttattatttacatagggcaaaatggttgagtatctgtttgattcatataattcaacctaacttaactataaagacttagtttccagattttgacatcctggttttgtgaggagtactttcttctataattacagatgatgatcattcctcttcatcttacaagtgttaataataggaacaaaaatgtacctgtcagaaaacctctatggtttatacctactacaaataaagaagtgagaccaagctaacaattctgaatcgcctttttaaagagagaaccatacactttccattcagttgtttgaaagaagagcagtcactcctttttgttttggctggtaacatttcagtaataacattatctgatattgttcaatctgcaatcaattagcaaccatcttactaggcatccagttcttttatgggcactgtaacccattaagtagttaaaccaggtgtgaggattaagctattattcttcaagtcaatgagataatggcttatgcaggttgacataagatgtaccatgaaatatttattatttatcatgtatacattaagaaagtaaaatcagcatgggatgatctcaggaaagcaatacatattttttggattagacattgaagtaaagtgaatgtatgataaattgacaaattaacattgccaatgttatgaaaaatgatgtagcaaaaaaaattaagatgtattttcatttttgataaggggttttccctgttatctgttaatttcttgtgtctttaattggcaaaattaagcactagtgttacagaagcccaaagtgagggaaaccactcactttcagaatgtacattagaagtttaaaactgtacccagattttttgtctcttttttttttattagtaggcctctgttaatagagtagtagttgcaaacacatacgtgggtttgccagtaacaactcacaatttgtgcaaagttgagtcttcgaaactgagcaaatttgctctcaatttcccgccagcgcttgctgagctggatctgagttggctccactgccattgcggccccatcctcagacaagccctcagcttgcctacgcactgcattcagctcctctttcttcttctgcaattcccgatcaatttcctattgagcaaaaccaatacagggcccagggcagttagctaaccacatcaaccgacttgcaagcagcaaatacttctctcaaaatttcaaaggctgttgtccctttattgtcatcctttgaagtttacaaatatgaaaggcatgactgtcatcctcgctcaataacccaaatattatttcagttatcctttgaatgcttggttttagatattctaattaagtaaatattgaaattggtctaacattttctttcttctaaattcctctggtgtcttgggatttgaaacaatttggagtgataactcattatttattagggaccgtccacatagaatataatttagagggtaagtgaataagttatttatttcctttttaaaggtttgaggaactcaacagagaatgaagcaaaataaaaagtgtaaaataataacagaaaaaaacatatttagacaatatgcaaataaatctatagagagtgaacactgatgtgtgaagatgctctgatgaaatgaatgggctaacatgagtaagaagtcgtccatataccgataagtcattagttcatctggaacaaagatacacaaagtcaattacaattttaccagaaaacacatcacatttcttaaatcactttacatagtctaaaacattttattcattcaacattacgtcaattgaataacacttaatacaatacatttactgaaaacaacacacaatacaaggaaatgcatcaaatcaaagagaacgttaatagaaacaagaacatcaacattttaaatatgatcttcacaggttaattaaactgtataataaaatctggtattgacattctaaaacaacattacctttattttcctttcatctctgggctcaggtaggctggctaattttttttcaatgtcatccaagcatttcaggagatcatcagcctgcctcttgtactgataccactgatgagaaatttctagagccttttttcttctttgagacctcaaatcctgttcatggtgcagacattattaaaatatcaatatatatgtatagtgcacttctggctgcagttatttatcaaaataatttgcgtccctcatctttttgtacaacttaggttaaaatcatatttaaatgcaaaatatacaaagacataattaaattgcctatgcatgaggcgggacccatgtataggaagctaagaaacctgaataacacacttaaagtattttctcttagcatgttcaaacttgcttaaaaattttgtcacattcaattgactcttaatgagctaactgttgtgtagtttatgtgcaagagtttaatatacgaatacaattgacttaactagatacaaactcacaaacctagtgagtttgtatctgacttaaaataggtaaaattctaaaatgtatatctttagccttggggctcatcaacaaaactttatgtactcaaccaatatacattcatgtttttagaaatgcctacataagagtttcataggccattaatattttatgattagaaatataaagccattttagttgtcttataaactgttccaagctgtatgtgtagaagtgtcaccactgttcgtatattggtgaacataactaataaaaaattatgtgagataaatgcttctccttccaaggcttgcatagccacatttatcttactataccaaatcatgctctaaatgcaaaacaattaactatttgaaaaaagaaaacagcaagtgcatgctttcaaatcaatgtgataagactaatttaataaatcaacaatgggaggaaatcagtcatcatgctctttacaagcacactcaatatcttctgtgattaatagaattactcaaaatgccattttataattcatgggaacataagctctgcatgcagctttcatttctacagaaagtagcaattagggttttattcacaggtttaattcgagcgaaaaaataataaatatcagggaatttctaaaaatttcattccattggaaaattttgaccttctctaaaatatttcataaggaccagaattggaactatttgacaggtttaaaaagttattgaatatgttggtatagattggtttggcgagtagtgttgacgattttgattaatcacttatagcctgtatttgcaagaatgaactacatttcattatctagtttgtttaaaattgggaatttaaaccttgctgtactttatgttttatgttgaattttcaaaccttctgaggagtcagatcgaacgctgcttttttcaaaggtagcaagatacagccacgtgaattagagttgagccatgccttatttgtgacataactcacatctttgccaggagaaagggcttggtggtcatcaatctgaaacatctttcatttcctaagcacaaagtgatgtataatatgtaaaatatttagagatgtcatgtagatttctttagaggaatgccagatgaccattaaacactgctattcagtaggacacacaccatcatacgaccagtgtagatacttctgaaagcttgctcacagttggaagggtgtgagttacatagcgttccgattttctagacacattatggtgtgcttttgcactccctcgaggaagaggccttttctgtttactatatttatcagcagttaccttcagaacacctgctggccaattagactttccttgtggattccttgcaggcacaatattgtgtaattacattctcagcagtgtttatttggttgactatagggggaaaggttttattctcttatttgcatgtagaaagcagactccatctacctgctaggtggatccaccttcataactacatagctcaaaagagtgatttacaaggaaaagctcagcaattaaaagtattagaaaatcagccatgcatgcaaatagtgattattgcaaagcatatacaaaaaaaaagtttcacaaaactttccacatgtctagtctcaagaacttcctagatattattatagaaaaattaagtttatcctgctcttcctgcacaaaccagatgagtcacctggggacttgaagccatacactacactgcttaatatgaaagtagcagttcttattcaagggcactaagattattttttaggattcctacataaatgaaatttgactttgtagatagttgcaaagagtgactttcttaaaggcataataaagttttaaaaataaataaaagaatctagggcttattaaacaagtatcaggttaccaaaaaattggacctaatgcaagcaaaatcaattaagtaaagaaagcaggaataatggatacatgtagatcggttattctggcagttaggcaggtttttttcaatataaagtagctgataaaaataaagcacattagaaaattaaatgtataagtactatgaatgcattcccatctttcaattactacttagaaaaatatgtctttaaaaagccataacttttaagcaacacatcgttcaaaatcaaataccactcaaaaatgttaaataaagcatacacattgaacagaaaaagtgagtttctgatgactaagtctgaagcagattttattaatgcacattatattttaccctatatattaaaaaaaaaccacaggcaaggtatattataattttagctctaataccttgagagcattatgttttgtctgtaacagctgctgttttatctttatttcctctcgctttctctcatctgtgattctttgttgtaagttgtctcctctttgcaacaattcttttacagtaccctcattgtcttcattctgatcaaaaacaacaagtacagtcttcattttggtttttaaaaagctgtacattgttaacagagataataagacatgttatttaaacacacacaaaaatccaatttaaaactttcatggaatgctattataagatactgtgctcatagcctttcttttacatttggtacttgaggtttcaaaataagtttcctcccatctagttgtaaagaacacatttttaggggcacctgtagaaagatgggggagtgtggtacttcatcatgtcagacaagtcatgaattactgtgaaagtattcttttggcttttttagtgtagttctagaaattaaaacattagagaaatgagctaaagttatcatttataatgttaactgatccataaaggaatacagatgtgtatttgtgactgagataacagcaaatctgaaaatattaacacacaactacatgaaaatattttgatttaaatgtacactaattcctatctaataactcctgcttcatttctgaaacctaaatgctcaatattaataggagaaatatcaggatattaataaaaatcatgtgctaagttaccatcaaataatttctaaaatatgtcatatatgcatgttaatttaaatacgatcaaataatactaaaatatggactggaaaatggctttaaacattttcaatgggtattttgttcctttaggctgcaagaacaatatcttaattttctttacttagaaataaaatgttttgaataaatgctggtctaatatagtcgcatatatgaccatgtgatttttcacctttagttttctttctttcaactcagaatgtgaaaactttgtatcaagtagtctcacattgtaatggtactcaaggtacactgatgacataaggaaaacaaataataaatttcaaaagtcacaagtatttgtatgtgtgtattacaattcaaggaattagatgttatatatttaaatctataatgcataaacttcaacacgcaactgaggactgattcattttgtatgggggaaagggattatttttgtcagagactggtcaataatctaaagaaacatacggcataatatagacacattatatacttatcataatatagacacatcatatacttatagtctgtaaaagactttacttattttaaaaggtgttgtaaaagtctgtagcattttctagggctgaggacaaaaacaacaaaaaattaaaaaacccacttcacttctttccctataccagttgagggctctagggcagagttggggtcagcccaagaggtaatcagtactttttttcatcttggtgccctctagtttcttctttgacctgaagtagagattgctgtaactcagcaacttggaaagcctcttccgtctttccacaagctgagttggcaaggccaccaaaccccatacatggggagtattgattgaggcagctccaggaagtgggaactaagattggtgggaatagttctcctattgcttcacacacttattacctaaaatttatatattgtcttctgatgtcactttcaagcattgtctgagaaggctctagcactggtaattgtaaaggttaagaatgccacagaggtgatggcagtgaaagaggggaaaaaattgtgaaaaggaggatgaagagagaaaaaaaaagtcagttaataaggatgtgatgtacaaatattcaagccagagagaaatgtagtagatactttgaaattagttgggattgaaggagaatattctgaggttgggaagagcacacatggtcatatttctttactcccatgaaataagcagcatgaatttatacacattttagacatataatgtactaactaaacaactatttggtaaaacaactttgtgggaaattgtaataaataatgttcatattatgcattattctctcttcattgaaataaatgttatactaccaaaaacattgctgatacaaaatgtcagtcatctatgatagttgagtattttattaaatttttagtttattttatgattcgactcttttttccaattacattttgcccttgataagttcaaaagtaggtcaggtcaaaagaaaattgctgggctatttattagaaaccgtaagtgctcctatattaccataccatagtaattcagcatttgtaataaaaggccaagaatattctgcatttataaaattcattagaatcataaaatgtgtaatatgtgctctgaaaattcagttggagacttatctaagttctttccaaatatttatttccactcctagttcattcacacttttatcacaaccaatttaccatatctttattgaagtcttcctctttcagattcaccccctgctgaatttcagcctccagtggttcaagcaatttttgtatatctgagttaaactgctccaattccttcaaaggaatggaggcctaaaaaaaaagatagtgctactttaaatcaaaattactttttattagaaacataaaccaaaagaaatacatttattcaacctcctgttgctaaactaatcacatgcattatgtttccatattatgttttatgaagggttttgaaatacaactggaaaagtacctgaggatgcaaataaggagaaacatttcacatcaccagagctgaacatacatgcaagatagtacaattcatcatttggtgatatcaacaacagtcaatttacagatacatttgaatgggctaatttttaatattctaaagtcaaatttgaccttattttaaatattctgatataaatacatttgggtaaatatgtctcatcagaaattgcctcatttatcaagtaacagtaacctcaggtagaaatgcagaattgtcatcttatccttagaaaaactacatggcaatctgctcagatgttttaaatgacatttttagcacagcacaattgacaggcatgctcttctaagacaatgccattagcttgccttaggaacagtttggttggtgatgcaaataaattcaaacgaatgaacctaatatatttcacataaagaatctatgcttttcaaccttgtaaacatcagtttctttacttttgaactgataatgaccagtctaagaaaactttaaaatctcttgactttctaaacaaaacccttgaaaaggagtgataagtgaaaagacatggaaaatcaaatatatattcaaaaaagtgggcaaggtttagttattagattaaaattctgttaataaaatacattgatactctctcaatctttatgctgtatttctttccattaaaacactagaacatattttatatgggatagctcttgaaaacccatagatgacatacagaaatctgattttctttcagagctaaaacattttacttttgtaaaaccaattcaggaatgacccccgtgtcttttgccaagacgattacattcatcaagtttggtccccacctacccttctccagtcacattcccaggaagaggttgaatttttattagatggcaacttctggtgaacaatacggataagtgtagaagaaaaactaaatatctaaaggtaataatctgtcactattgaagaagtgaataatcaaattctattcatgatgacatgattctcatatgcaacatgaataaccacatatcttctaggtacttctacacacccctgaaagatttatgagataattttaagtgacctattacagtaccagtttttaaatcctaatgatcatttgccatttgaaatatcataagttatttgaaccagtatagattggtagtggtacaaacatgcttaaagtttcaatgtctgtattattagcaattacggtacaataaaatcatacactgtttagatgacggtaaaagtaaaaagattaacaacccttagaatcataactatacaattatcaatttggtgatattttatgttattaaatggttgttcacatttgctaatatttaatgaaagcaactatgttctatgtgattttgtgaatacataatgataatgttgaaaataacttttattgtgtacttggatgtcagaagaacataggtctatttacagtcagatttacctgttttattccaactgcttcttctctagctcatctctccatgaatttaacttctattaatttaagatacaattttctacgaatttaacaattttttatgccttccaagtcttcaccctaagctgttatctgacttttgaattcccatctagactctccaatagccagctgaattttcacctgaagtttcacattcctagtatggagcacattatctttcccgcaaactgcttacaatactaacttccctagttctcttaatggaagaccatttctctcagtcattcaggcgtaaaacgtaagtcatgctatttttgaacatctcactctaatgtctaataaatatcaagtaagtgtcaattgacttgctatgatccacttgctttgtattcccagagactccatcgttcctggtccttacacaaaactaaggcaataagctttgaaaagatgtaaaatctcctttcagtcaaaccagttccagcctgtgcccaatgatcagcttactatgtttcaaaaacctttctttcattatgctatttatttgctgaagaacctcctgcatctattgagtataaatagaataaagtccaacctccagcacagtagtcaaggcttctcctaatcttgccccaaagacttgccagccttatgtaagtgttcctaatatagacctttttttgcaggccatttggtgatcttctgttatgcctccttcaatgaccttagaatacttttcatcttctagtgaagaacataaacttctgtatgaaaatgcatagattgaatctgggctctaccatttactagctgagggaacttagacaagttatttatcctcattgaacctcagtttctttataacatggagataagatgaatatctacctcacagggctattactaagatcaaatatgttagaatggtgtctggtatataataaaagcttaataaatgttgactattattttctctcaaacttctatgtgtccatccaatataaatacatgctctataaatcttgggtcttattttgatcctctcaaaatcctaatcatccattggctcaggtcaagcccttcctcctttgaaatctatggttttaaaggataaaatacatgcttattgatataatgagtctttattttaccaagggatttgatgaaatcataacattgtaatggtgaacatggaggattttagattccagtttggtagagttacataatcctgaagaacaaaactacagattaatttatctgcggcaatataaaaagtgatatcacagccttgcatttagtttacagggtgcagttttttttttttaatcaggaattatttggagacagaaaaggcataccacagatacagtcagtggggtgtgttccctagacatcctatggagctgagtttctcatgttcaacctacagtcatttctggtacatagtaaatattcataagtaaatatttcctgaaaaaataaatgaacaaaagactaaaaattgagggccaaaatagacatttcaaggagcttttttagtgacatggaattttaaataacacaatttctatgtagaaatgtcaaaagacctgactggttagcattatatgagtatgtatattaactgctgcccaaatgctaagcaacatgataccaccaggtaaacacaaaaaagggggaagatgtaaaaagagctttgggagagactaccaaaaactgaagtgctaattattcaggcaagataatggaaacttagacttctttagttcaatgtgtagggtctaaattttccaatgaaagactaccgtgcattttgtttaaaaaaattaggaagattaagaatttgagtagttttattttgtgtagtttcaaagtgattaactaaaatcagtgggcaaaaattatttggagcctaaattttaggtttatataagaacaactgatgaggactgcaatttttttaaaaacactgattttcaagtaatgctaaatgtttataagcagagactagatgaggatgtattcagtcacattttaggaacaaaatccttttcacacagacattttcttaaaattttataaccttacagtaagttcttgtctctaaattcaagtagaacttttatagtagtgcagctcaatagaaatataatacatgccatatatgtaattttaaatattctagttgccatagtaaaaaacaaaaaacagataaaattaattttactgatttcactgagatgtccaaattattgtataaactcataatcaatacaaaaatatgaatattttacattttatattctcttcaaaacccacacatattttacacttatttataaatcttaacatggagtagccaaatttctaaagctcagtggccacatgtggttcatgaccaccttattaggcagtatagagctctattaaccattatactcataacattgtaaagaactaatatctcataattactttgaataaaatagtaatgttttgtttataacttgtggtgaatttagattattcttacgtcggtcttattatcttgcattatgtgttctgagtgaaattttcaggcagtcctcggggtataggaaaaattacgggagtgggattgacctgttatttcaggagtttctattctcatttatgtgtatctcagcttgtgttgcactgctttcttatagacaggaatataatattatttggctttcaaagatatatgcttgtctctctaaataaattttccatccttaaagttggcaatatgtcttatactactctattttccagtgaaaacactgccttttattttatacaggaaaaggtgcttattatatcaatcggtagttttagaactacctatatattaatttaatcaaccagtgaccaattttataaccaaaataagtttatcaaaccaattgttttagctatgttattggcaagatagcaccagccatttgacagccatatgattaatagtctttggacacaaagagatgaaaaaaattcattgcttttcttaagagttcactagttcagcattaggctatgcccattctaaaacagaaaacactttcccacccaattaaaattctacatgtcattccttggtcttccctgtctttgtaacttggaattcttatgcaactttataaaggaaacatgtaataagaaagcgtttataatttaacagctcattcttgagtcaccaaattttaaaacacaaagtatatcatgcctgcttttcaattcagaattatgataaattgtctaaaacagttgaaagcaatggctgataaatcatcttaattattgggtaagttacttctattgactttaaaggaaatagatgaccacaaaagaactggaatcacaattaaatcacacaatgttagacagtgcacacaaaataggttttagttatatagaaaataatcaaacaaaagttataatattgcatgagaaagtgtataccaagcataggttttggacacttttaattttttacttaccttttcattttaagagctttagcatgactgtgcagtcatacaaaatacatataaattagaagacagggaagtataataaatggataaatggacacataaagaagagacagagaaaccgagaaagacaacactttgttttccttgattttttaatgtttcaaattgcttaacaactattaattgtgctttgttggattatttaaggattaatgaaatttaaggctttgttgaagttttggcattaaagctgaattttataacaagttaacaaaggataacagactgaagaaaagcaagatcaattacaaactgattcattgtaaattgaaagcattcaaaattactcagatacactttattagttttaaaatgtaagctttccttggttaaatattactttggcatgcacagatacactagcataataacgactgtgtttacacagacagcaagtaaacatttgttaatctggactatggaatcttaataatcatgataaattaccactatattcaaatcacactaaaacctaaattgaaaataaataatccaagtgctacagattggtttaaaattgcttcaaatccatcagtctcctttttccattctgcagctttgaaaatttatttatcattacaatattgatatagaaaaataaagaattcatggaaaccaagatgaaaaatttcaaggacaagtaacacactatagtacagaaaagacagactactgatatgatatgaagagttatttcacatcattctatctgtagaggaaaagaacttacaaaaacaaataagtgtattggaaagatactacatctatgctagaagaaagattatttaaaatatggtttataaacttatttattctattattttaaaattattagagcaaacaagaaaatgtaagaaatattatttttaaattaaataaattgactccaaatagtgacatttcattggttgcattcttttgagaatagataaagtactggtttacctttaatgctttgataataaaaatgtgaaaatgtgactaatttgtgaggctaattagaggatattacccagtagatttcaattgattttgtatggatgaggttaatttcatgcttacacattttaaaactggatgcaaaatatattcgtgggtcaagaatctgcttcctactgtcgaccttttataaagtttaacttagaatattgccctatttcatgattacatgactttttggagtaggaaatgaattaaaagaggaaaacatttaactctaaaatgtatgggggagacagacaaaagtaaaaacataacactttaagcaattttgtattttaaactttcttttcatttacttaggttgttttccagttttatttcttccattcccccttccttcttccatttcttcctccctaccaccttttgttcttgtcatttttaatacaaaaagtataacgaaatcactgtatttgaagtgaaattgggtatgtttatactaacacatagtagaccaacaaaaactactttatgacataaatagaggcagtaaactatgctgagtcagtgtattgaagtggacaaagcaatggactgagatctagtatttgctaaccacactgtctaactgtgagaacttggtcaactcactgacactctcacaacctcctataaatatctgaaagtctctggtccaaagcaaaattgctttacatctactgacactgatcaggggactaattttcctttatcaaaggagaacaatcaagattcaccaaatagctttaattatttcaaatgttatgctaacaagacccagatagttttatcaaatgacactgctcaccaaactcaattacacatctactttaaaaatattttacatggttaccaaagggatttattagcgaagtttcaatggacttaaccttgttatagggataaccaattacacatgtggaaaaaataagctaacataagaattatgttgttaggttcatatttttctgattcattttagtaaaataaaatttgcagatattatacagtttgactagtgatctgttactattacctgaagatattagttgtaaatattacatatttaatgctctacaaattatgcaatatttacaagtcttcatctcagttttcatgtttttatagaaaattttactaaaaatgaatatctatatacctacaatgtacctacaaaaattaaaaaaattaaaatttaaagaatatatatagcaagaatactgttccaattaagatacaatattattttccatcataggtgttaagttataatacgatcagaaagagactgcaaaatatcaatgtatttgcattgataaatctgactacagaaaattaagctttaattaaaaattttcaatccaatacatcttcattggaccttctagatcacatttataaaatgcatcatttatttcccaccgaagtttaggagagccaaaataattaaatcactgcttaattattttccacacatagaaccatattttaagatagattaggcccaatcatgtgtttctttttcttatatattctacattacatgggaaggtcactgactctctcacagcctcctataaacttgtgaaagtctcttatccaaagaatgattacttttatatcttctgacactgaatggaagtaaaaaaaaaaaaaaaaaaaaaaaaaaacttggtaatttacaattattgcagcaatcaaacaatgaatatttaagtatttgatgcccgattgtccaaatctcatattacagttgtaatacatatatatagaaactgctacatgaattttagcagcaattttcaaggcctatatggaaattaaagaacatatgccagatatatcctatagcaaataagtcttagtaaaggatcaaagtcagagaaaataatttcacttttttctggttagtatcaatttcagaataaataatttaacatttcagctccttagaacagtgaagtatatctaaatctctagaaaaatacaatctaagcaaattttatgtagaaattacataatattttgtaaaaagtaaaataattgcctttattaatatgacacacctaaagtttgtttagtcaaaattattttgcagctaagtattacaacaataaaaatataacttgatgcatattttattattgaaattttttttaatttttatttttgagatggaatctcactctgtcgcccaggctggggtgcagtggtgcgatctcggctcactgcaacctccgcctcccgggttcaaacaatttccctcctcagcctcccaagtagctgggattacaggcgcccaccaccatgcccagctaatttttgtatttttagtagagaaggggatttgccatgttggccaggttgatcttcaactcctgacgtcaggtgatctgcctgcagcggcctcccaaagtgttgggattacaggcgtgagccaccgcaccaggcctattattggaatttatatgcagactttcctagtcaatcagagttaaatttggagtcatttttgaattcatcatcttcttgggtccttgtatgtaatgacttaactctaggctacctctaaatatctccgcagcagcagttctctaagcgtggtccctagaccttcagcatcaatctgacctagaaaaatgttagaaatgcaaactcttgtgctccactccagacctagtgagtcagaagctctgagtgtggggcccagcacactggttttaacaattcacccaagtgcatacaaaagatttactgatctagactgaaatttcctttccactcccatagctatccctttttttgaggtcatcagtgtatctcatctagactactgcaatagctcccgaacttcatgtcattattcagtggaattctcctcacaactatcactggactaatttctcaacagtgcatacacagatacacacacacacacacacacacacacacacacacacacagagcacatcaagaactcttcattgcatactgaattaagcatgaatgattagtctggctgtccatgacctcttcacactgtgtctagccataatcttcagccttatcatccacaactaagttttatcttccatgccctctactctgaaaactaaaggaactcactcttcattgaacacactgtatgctcctaagctttctcatatgtttatgccgaattgttacctcctctgtgttgctggagtgactgctaaactcacttaccatgcactcactctcaatctagtatccatgaacacatcttgccctatcatcaaacagtaagctccttgaatccatcgtattttacctagcaatagatccccctcactaccaaacactgttatcggaaaataatatatggttggtgagaattcatcctgattaatcccttttctcaagtcttcactcattagtgcttttagatatacctcaactagcatctctcccaaattgctgactccccttctccaacttggcttctagagggatggagaggggtagaactgtcataattaatatgaataaataatcagtttatttttgtcttcccatgccccttcctatacttttgtctcctatcaccttattttcccgatggtatccacttgccctcagccatgccactatactccgatgccctaaaacagagacagttgagacaaggagtctctcctcattgattctgtcaatttactcagggttctaatattatctctgattgactgttgcaattctgatcctctccattaaaactgccatttcctcacattgatttcacatagattacgaaaaaacacgcttttttcaaagtcattggatactcttaggtaaccttaataaaatgggaaaaggcagcatttttatgtattttaaggggcgtatgtgggacaaacataactccttagtagttcttaaattcatccacttcattatctttaaggctggtctttgtcatgaaaatagcaaagacacgattttctgactccagtcgattacagcagagaccacagaaaatcagcaattctttcatttttttccatcagtttttgtctcaaccccccagattcggccattcaagtgtaatatacgtaacgatggaaatacccattgatattaattatttttaaccatttcatatctatacactgattaatacattttaaatgcatgtttttacatatattacataatttgatcctcattacaatctttagattaaaataaaacaggcatcatctcccttattttgtagctagaaatgaggctctgagaggtaaagaggcatatccaaaatcactaagtagtaatgtgctcagctagtgctcaaagcaggtcttgtgtcttgaagttaaggactttttgctctcaccatactgctccttgctgaggccaaaattaacattacagagagctgcacttggacagtcaagtcctcagccaatctgaactgaggatccctttactcactgctttctgggcttcggaatttcttgtcatgaacagtcctggcaggagacatgggagtaccccactttgtattcttcaccaaatagtaaatctagacaccagtgaattttcagcataagttatttctctattcaagggctctttagagttatgttctaaaggctatactgaaattactgattacaaagagtctatgacctacccgtgttcaatccaaatctactttttttatcaccatagtattttttttccccaggttactcttccatgaaacttagacatagactcaaccatagaaaagccatattctaacctaatattatcctgtataacccctactataaagaaacctgattttgagatcaaaggctaccccctaaaacctccagcacttcagcacttccctactccagagcaaacacacacaagacattaaatgttttcaatttcttattgtaatcaacaaaagattactgaatagccaaattttagaacgagcagggatttatgaactaatctaatttagaaatttcaaaccatgttctatgagcataatttatacttcctgaattcaatcataggaaggagaaagataaaatggcagatatttcccccatctagtaactctattattttccaatttattaatttaattttaaataatatgattttaatattaaatatttaaatttaatactttattttaaataataatattttgggcaggataggttttcttttaaaaattgttagtctattttaacttcctcatcttacaaacaatgaaatggatatgcagaaaaatcacatattctggctactactgaaaaagttaggcctaaatctcaatcttctaaatccactgttttctctggtgagattaccttctaaatctattgttctctctgccgagatcatctcaccattatttgaacatccccatgaagatgaattagtgttaaacatattttatgattatactaagtattcatttctgtttgaaaacatgtatttcttaagcaaggatctttatacccttgtatcttctcaccacaatctctaacacaatggaagctcaatcccattagctgatgcaatgaatatataagcaaagtgtcagatatgctttatttctgtgtttttcatttcatcgtgataatagagcataattatctcttcagagccctaaaatggggtcattgttacactcagttgcctttactaatttagagaaaaacaaatactttgaaaagcaaacatgtgattattttgttaattaacatataattgaaaatctggggccaggcacagtggttcacgcttgtaatcccagcactttgagaggcccaggcaggaggatcacttgaggtcaggagttccagaccagcctggccaacgtggtgaaaccccgtctctgccaaaatacaaaaattagccaggtgtcacggcgcccgcccgtaatcccagctacttgggaggctgaggcaggagaatcacttgattccaggaggcagaggttgcagtgagctgaggttatgccacagcactccagcctgggcaacagagagagtctccaccacacacacacacacaaaataataataataataataataataataaatgaatattcactggaaatttcttatgccttatgtttctagggaaaataaaagaagttcatagagtggatcactttatgcatgatttccagaagtatacttacaaattcatgcagaatgtgaaatgaaaactcacaaacttgtcttggtcacaaacttgtattggctgggtctgtcacatctgtggtggagagcaaattctacccattttttaatatctgtgaaccacaatcttgtaacacaatttatccaaagataataccttattttctcttaaatattctatagcttagtgatttattaaaatgtgcatgtgtgtgtgtctatatcttagtaatgaagtagtagcattttttaaggattgaaataaatctccattcattgtcttgttattacataagccattgatatctttagaagtaaaaacaattgtctttgtaagtaacaatacattctttcaaaactttaatcaattttaagagcctgtcacatttttttgcaggtaataatgactgactcaaatatatatatttgtgacagttaactactaagttctctcatgctgtctctctccatatgtagagaatatagccttttaaaagtcaactatataaggtctctatgtatggagagagagagtacaagagaactaagtagttaactattaaaaataacttgcaatgaattaaggtaaactaacaactttttaatttgggaaggtgaattttgaagggtaactgtgtctcatgcatacaagctaaactatttagaatttatcatgtcacatttcacttattttgaaaactactttaaatatgtactattatataacatgatgagacactgtaatgccttagaaagtgcagcaattgtgaaaccatgctattactggttgcttatatctatcaaaatattttttgaaaatgttctatttttccaggaatcaatacttacctgacatactgcatcatattttctcataaatactccaatgtttttttcatttcagattatttctaacaattatctatatacctaaatacatatattgattttatatacatttttatgtttgaaagcatatcatatatattgaaatttatcaaactacagtatataaatttctaggtaattacttgcatttcaaatcttcccaaagagctgaaattctataacactatatttatacatttttgcaaactacttattaaataagactttctcttcatcaaatcatacacaaatataaagtctatcacgcaaaagttccatattccctggttcttcttaaacagtaatataaataggcatataaaattacaaaaattaggatatgtaagctttgcaatgatttgttttcatggcgtgatcatttcattatagcctaatgaattttgtcacagtgtctacaactagcaaaagcaagttaaacaaacacacttgcacaaccagtaaagaggtaaaaaaacaccctagaccgtgcagaagatgtacaagacctcattttggatatttgatccacattacatacaagcaatattgtatcagtactgcttttggcaaaatttatcggtagtgctttatgttgatggatgacttgtgtgcttttggttttatttatttttttggccttcagcatgctatttgttatttttttctgtaggtgacccctgaaagtacgtatgtaaactgcagcatagaatgcagtcctagaatatctatggcagcaaaagatgagagagaaaaagagacagagagagacagagagagacagagacggggaggagtggcgtttatctcccattataatcagtggtaaaatttccttaaatacattttggcattcattttccttttgaaaaccttgctgtggggtctacttgcccctttcagagtactgcgcaaccttcgcaagagaccatttagcacaagtttccaccttggagtagatcttcctacctttccagtcttaattctgtgtgaaatggctgcaaatcgatggttgagctctgagatttggggctctactaatttcctgcagtggtcaccgcggtttgccatcaagtttgctgcttggtcacgtgtagagtccacctttgggcgtatgtcattcagttctgcctttaaacgctatattccatgagcaagagataggacttgaagttagtaattaatgaaggtcaagatagaaaaagagagccaaacagagcgagtgagcaagtgagcgagaagagtgagaaagagagagagagaaagtaagaaaatgagagcaagcacatgcagaaaatacaaagggagataaaaccacaacttccataaaacaggactaaaatgaaaatgcgtgtgatttcagaaaaatagatcaccgtccttaagtttgatgcatgtctatttaaaatgtttatttagtccgaggaaggacagggatgttttcccaactatgttgttgcaactatcataatatattctatttagtcttattttattatatcgttactgaatttaatagttgtggaatgaactaagtatgtgctcaggaggtcaggtagctgaagaacacttttctattccttcctagcactttcaagttcctctttattacattgagtgtcataagaaaaaaagtgattttctaacacatacgaattttctgtcacatacagaggtactgaggaatgttcttcctgacctgccgggtcacagaggttgaagttaaataactcagaccctattattcaaaaagccttgaaggaaattcaccataagatgacatctctgactatacatcaagggataatgaagagcacaatacagatccacatcaaaataagcttcagacaatggcataaatgtgttttggggatagcctggaatgaatttatagtttttcattaaaggtatatcgtaatctgtggaaaatatcagaggcataaaaataaattgcatagaaagaaacataatttttgagttttctttaaatagtaaacaactaatcaataaatttatcaaacattgcagcaaaacaaaataaaaaatgtttattgaaaagagagctgttaaaattcaactctacctatttaattgggaaaagagacatcatcaaatagaaacaatgtagtgtctataaggtatatttgcgtattacacctctcatacccttttatcggaatcattttttaaagaaaagattaagttccccttgaaaaagaagacagggcatcctaacagtcagttttgagactaaaagaaagaacccaaagcctagtttacatgtagttaaaaatgaaaacctcagctttacataagcccaacattaagactaattaccaagatttggatatggcataggcaaaaaaatcagctgactggatttcaggtgttcattcagatgggctaaatgaatgatagtgtcagattgttctttgtgttagacacaagaatgtagtaccaccattgacaaaggcagaaatttgcaatatgatttcaaaataaatcttggaatatctttctgaacggagtttacattgggtataattaactgagtgatggatttgaacagaaagtcagattacagaactcttcaaaatcattcatttccattcaaagggggaaggaaggaaaaagggaaagataaaggaaggaagaaaggattgttttactcttattaagacgtccttagtatcttttaggacaaagatgattgaagtaactggtgtacaatttggacattacttttcatattttatttgctaccttaagcacgtcttctttttgctggggtttctttttctctgattcatccaaaagtgtgtcagcctgaatgatccactttgtgatgtggtccacattctggtcaaaagtttccatgtgtttctggtattccttaattgtacagagacataccatggcattattggttagacaatattcttaaagaatttttcctatgttctaaaatgtttaaaagacaacaataaagtttcattgagattagttttaagtggtattttcatatagaatattgcgtaaatataaagaaaaatatattaaaatattgttatagatattgaattaagagccagcatatacgtagaattgagaaattttcaaacacagaattgttactggtcacttatgtatctttttctcgtgacagagaagggtgtaaaagcttctagccttttctcttaccaacaaaagatttaaccactcttctgctcgggaggtgacagctatccagttactattcagaagactgagtttatcttccaccaacgtctccttcttgcccaaaactgttttcaaggcctctcctacctctgtgatactcttcaggtgcaccttctgtttctcaatctctttttgagtagcctgtgaaaaggagagcattgaccttcaagtaatgtcttgtagtcttaagatttaatgcttatgaaacggctttctgtatggttactatgattctgcaaggttttaaacctataactatgtattaatgaatcatgaaaaccataccatatatactgaagcttcattgttgggtaactatgaacatatatatgtacataagcataattcatgtcttatttttcattataaatatttaataaacatacatattgttcaactaaatatatttatatttatttaatttatacatgtagtggctaaaggcagatatttgaaaatccatccacaaataagaaactgcccttagaaaattctacagtatggtgctactgtatttctgcagcagggatttttttagccttttagtgccatggatctttttggcatctgttgaagcttaaaaacccattctcataataatgcttttaaatgcataaaacaaaatacataggattttaaatgaaaacaattatactgaaatacaatgtgcaacacattttttaaatatttgtgatgtagtaatacatgttttatttcctaatatgttaattaacaagatctagcatcaggtctttaggataatttcaatgtagtgatgacgagcataactggtatttttaagtatgtacaatgtctggaacacgttataaaagtatctgtcatttctattagtgacaaagtcatgggtatctctattgctggagtttgttgctcacattttaactgaaaaaactgcttacttttggttttaattgaatacaaataaagataaagttttcccccaatccaagttcacagaccttatttctatccacataccctagactaaaatctcctaagagaataccactatttcctaagaggtgatttataaaacatgaaaacaatcacatttaacatgaaaaaagatagagagtagtgatggaaaaagtgatcttagtacaaaggtttactacctgccctgcataaagcccctttcctggtacatggcacggctgacagacaatgtggccactcggcattccactgagtctgtgcctggttctttccctgcctgtctagttagccagctgtgggacattcacagagagctgagccagagcccaacagaccctttttctcctttctcaataaggttaacagatacagagactgtgattggcactcgagttgaaaagctatttgcgagtggagctgatgtcttaatcacagaaagccaaagcaaaacaaaatcattgagaaacagcaataacaggaaagtggagaaagtccagatacaaataatcaattaataaacacacaaggagcagctctgtaatgccagcctacatctaatttcttaagaaaaaaattacagtacaagagtaagaaattaggtataggctggcctcatagagtcactctcaacatgtcttttctatctttataatatacctaagtagtcctgtggctgtctttctgccacgccataaggtcctggtccactcgaaatcacttctcatactttctgttttggttttgcctttggcatcggataaacaggagaaataaatgaggaaacaatgtataaaaatttttatgcaagacaaaaacactgtttcttcaattctaagatatggttttatgtcacattttttcaataaaaacatgcctgaaattaaggtacttaatgccagatgaactcgacagctatcatgcatggggttcttcatatgtaggtgctatttgttgcacacaggtgagcttagcaattcataaaagcaatttcttcatttatcaatcgtaagtgttgcctgagctcctattatatgccagttactactgtagcagaatcatatgtaattctcctcaatatattctgggagattattagaagtctctcatttgggtagatacagaccctttagagcttaacttcagagtagacatagactagattttattccttttaatactttgacttcaaccttttgtagtatacaacctctacaaccatagatgttagccattgttactaggctctgtgggataaaacggtagagaagtccccatccttcaaaaacttatatccaagtatgagtttgtcaaagagatggacatatacgcaaatgagaattatctactttctatattccagtctactggcatctcgctgtagttgatttattcacaaaggtaacccttcacaaagttgaagcttaatttatatttggattactaattatctcttaataagtcttcataaagatgacactatattttagcatcaatgtaaaaagttattgtgtacatagattttgtttcttacatgacaagcaatgcaattaaaggcaatggaattttccaaaactcagaagagatcacaaaagttttgaacttaggggataatgttgcaggtagttcctgggtcacagaaaccattatgtgtcaacatctggccaaattcctccagctaatttaaacaatgtccagtgatgttcagttgatgggaacaaaataggaaatgtggactaatttctagtgccttcttaagttccacaaaattataaattaaaactaaaagatgttcaatttatcaccattatcaacttgtatttgaaaaaagcagtgatatgatggtggtttataactgctaatggtcaaaagtgattcacaggacaatttacactctgtaaaaaaagagacctagagttaaacttttatgtatgctattcaacaataaggaaccagtattcaatcatttgtatacatgctgttttgggttaggaaaaaatattgtgttaatttagtaggccttaaatttttccctcaaatgtgtttttaatcaaagatatgacttaagaaataagacttaaataagacttagcctttaaatactatgctgagcttgctttctggagatctgaaatactaattgaccaatgtatatcaggtgcctaatatccagtctgtactgtgctattcactgccagagatgaggaatgaggtaatctttgcaaacctcactctaatcatgcctacagtgtagctgcagaggaaagcttaaatgcaataaaacaatttgatatcatactagaaaaaaatcacatttttttttggaaacagatgagccatggctggaataagcatgaatgactacaagggaaaggtgacacttgaaggcggagtgtgcatgggatggtttggattgactaaagacaaagtacgaagcaacgagaaggtatgaaagttagaatacaaggctgccatagaggaacagggaattcttactgtaaactaaaagaatacatttgatgaggttgttgacgaaccattttctctggctctaatagtttcccacaacacaagaatgtctgcatcttcagatgtatggagaaccaacctagagctattgccttggccattgtctttatacctgtactcattcctctcaaagggagctccttatttatagggttggcgagatggaaagaaacagctgaaaagatatggcatttcctccttttcaaaagcatccgattctcagcatacatgccttcttctgccttgtgaggtgagaagtggagagggttctagaagatctactcttctgaaggagcaagttcaaattcaatgactaaattcactaaattataactcagacactttaggtttttcagtcatgtagtaatgtgattgctgctaggatcgattttagggctgaagaaaaagcaagattgtgtacactcagttttaacttgacctatgacatgattgtaagtccaccttcaggagattcaagagaaggtgaacgcaaactatatacttggcactaagggtttttatgatagaggggaaaatatctgacataagtaaaatccaattaaactataaattctcacaatgtctaacatattattttccatatgttactttgtaacatttgatagctccagtataaatagtccaaatactaagcactaacttccatgatttcaaacaaatttgctgtctacttcttagccataatttgtaaatgctactctaatttccttattataaaagaatgagtataatgagttaatttcttccagtgaagtcatgccccatgttgatgggaaggatgaagaatacattctgattcattccccatatctacaagtataattgcttgtagaaatttaaaaaggcatgttcggttcagggttcagctatcggctcacttcactgatacagtagcaagatggaaaaaccttctccattggtctctgctgattataccatcagcatttttcattatttttatttaatggtagaacggtaaaaattattggaaaaatcatctggtcctataggaacacctttacaaacatttcccttcaggggtaaagaaatgtagctcacttaacctctattctctcctccacccatttcgtattttcacaagttttccagtaccttccacagattttcttggaatttctcagggacttatattcttaagataacttctctgtctgatctcttttttccaccccctctttttaaacaaattttattatcttaagagtctcctgttctctagagcttatcttcaatcagcaccacatttatttacctacgtaccttaacatcatttccttatagattcctccctttactaggactcaattaaattcagacttattttagctattcctttctcttactcatgttccctgtaatatgaataaaaggctaactaaagcatccataaaaggcatcttgagaagtccccctacccaggtgaattctgcacttagtatttgcaaatattataccatttctgatcacagagaacaggagagggttctttcaccttttagctacgtaacatattcgtggaaagaaaaggaatacattgccatattactgcaattctaagatgtgcatttgtcacattttaaggattcggaaattgagatgtaacatacaattaaggtttaccttgaaagtggtagtgtttttttttttttttttaaattctcagcagctgtaatcatatcaatggtgcatcacacaatctaacatgtcttaaacatgaggaaatgagatgctaattgcttttacagcccccaaaattactctatcatggctagaggtttaggacatattttactattaggctaatgtgacagaataatataatgatacattcaaaaagaacataaagcattaaatagtggattctatagcaatgtgtattgactttttaataacactgtattgtttattaaagaagaatttcatgaaagcagaatgaactgaacagaaataacagctctaactataatgacagtgaatagtgactccaatggcatgtaacagatgttctattttctaagtaacagctgcttgatgcattcattgcaccaagttaatgatctgctagtgttatttcacttcacagataaattactctgctcactttaaaaaaaaaagatacgtaatttttcaggggaatgagagtataacagactttagagtaagtaatagttcttatatttttatagctaagaggaatgatgagttgaggcagttatccagataatctaggaccagaaaccagatctctttaaactgtgaaatcttactgttataaaaaatatatatacaagacatggttgactgagctgaatttaggctctcgtcagacagcttgaaattcgcggatcttgtatcacattatctagtgattctcaactttgctgaataagagagctagttagagttagaccaattaaatcagaatctctggaagtgggccccaaacattgggatacttttcaagtttctcgggtgattttgatgtgcaaccaatgttgaaaaccacaggcaaacagaaagatgcattctgagtttttattgagtgatagtcattaaattctaagagtgaactgaaagccaaaggataattgagcaaccaatgtttgttcttcctgaggttaaatattataaaactttgtttccaaaataaacgtgaaaaacacggtaatttgttaaacaagtggctatttagacatagattattctgcatttaacaccttcagttaaatttattaataccatttgtgtgcgtgtgtgtttgtgtgtgttcctctcaggcaactcttggcatactaagactactgttaataaaacaggcggtaggatgaacatactataggaccaaattttttttttccagaaaatcttattctaccatttgaactttcagatgacaccatggatatttaggggtttaatggaactaaattatttaactgagttggaatctttgatgcttaaaacaaaattagaaataaaatgttagtgattaaatcagaaaatcatatagattagactttgtcaaagcttgtatttcccaaacataatgatcttcagggaagtaaacctctaattaatcacatacatatttactttcctatggttatgttttcgtgatcaattcatatgctaaacaatattggccagtaatgggatgttcagattgatttacttacactcaactaatcagagtgatattaagatactaacaaacaatatttgaaatctaaaatcacaacagtggggacagactacagactgtagtaggtgatagatacacacgggttttcattttattattttaatgaggacttatattttctgcacttgaaatttagccatggtttgtttcatgcttattgtgaataagtagctttttgttattttaagcttagattactttaaaattactagaaaataagacttcttatgataatttggtatagtggaaaaaactgttgaaatcaggcatagtattacagttttgctatgtaccaggacttgtatttgttcatctataaaacgggaacatttgatcaggtgattatttatgtttgttataaaacttgtacaattttaaatgtaaatcagcatttttctcttctctcaagaactgctttgtcattataatttgcaactcttaatttgcaagttacgtttaaacagatatttcatgagtatgtcctatgtgtcaggcaatatcttatgtacatgggaaatatcagagaccaaaatacacattttccctgtccttttgctgaatgaattactattgcctacataacagtccaagagagtaggggttatcatgaaagctcaaggaacttgtgcagttccagtattcaaactcttcaggtgctagtaatctcctgtagattgccttgccatttccttccatcatctctattctacagctatcagtgtttgtcacctcagcctagaaaattccattaacagaaaaggaaaagtatctgaacatttatggggtgataaatatcactgtgatggctgcctcgtggcattgctgttgtctggaccatgcagctagctaggattgatccatatttttaaaaacttaacattaattttaccctctttaatactactctgattgaagggtgaatttaaaaatacagtgaaagggctatgtcgctgtaggaagttgcaattagcattaataatttaaattgtcaattttcatcatcaatcttttatctcatttgttaatattctcaaatggctttcctcctgtcattttaatttaaaaatttttctttaccttttaaacaatttggaatacttttaaaatatattctttttttctgtaactataatttggaaacatggtcacagggtaaggggacacaggacagttttcttacctgcagctgtcccttcagttaatcacccctgaccacatcctcactacttctggaagttctcccattctttctctgtgggatcattaagaattagaatacctaagacattcttgagttcgtaattctcttcaagtagatggtatctttaaacatcttaaattgtgtcacgcaccacccagtatcttttggaagggctatgcattctagtatctatggtttggaatatgttactatttaattctgagcaggaagaaaacttagatgaatcattctatttaggaaagaccaattctacaacgccactggcctatcaaaaggatcccagaaatgtcaaacctctgatactcattcaagaagaagacatggcaaaattctatggtcaaacagggtgctgcttctatattagctttcctctagttcaggagtttgaatatgttctgtgaatggccacatagtagttgttctaggctttgtgagccatgcagtctctgtcacaattactcaactctgctgttttagcacaaaagcagccagaaaaaataaacaaatataaattgatacacttcaatagtcttatgtacagacactgacatatgcatttttaataatttttatgtgtcctgaagtatctagttcttcttttgattttttccaaccatttacataaaaacaattttcagcccatgggctgtacaaaagaaggtggctgaatggattaggcctaccaattatagtttgcccatctctgctctcatttatctgactagttaatttgccttcctcttggtgagagagtctcttaggcattcttctctattaggaagctcaagaagttggctagaattgatatggcccctattaggtcagctcttttcatggttcccatggtaacattaatcctcatattgaggatcctggacccacatgactttgaaatccttaggagtgaatgactattacaaatgtaatcatggtcaccctatgaaagcaatcaacatccgttattttctgactttttaacaaaagccattcagactggtgtgagatggtatcttatttagggtttaattggcatctctctgatgattagtgatattgaagattttttaatatgctcattggccgcttgtatgtcttctttcgaggagtgtctattcacgttctttgtcctgtttttaatctgtttttttttaatttcttgttgacaagtttaagttccttatagattctggatattattcttttgtcagatgcaaagtttgcaaatattttctcccattcaggaggttatctgtttactgtgttgattgtttctttttctgtacagaagctttaatttaattaactctcatttgtcaatttttgtttttgttgcatttgtcattgaggtcttggtcataaattctttgcctaagccagtgtccagaagaacttttcctaggttttattctaggatttttagtagtttcagggcttacatttaagactttaatccatcttgagttaatttttgtatatggtgaaaggtaggggtccaggttcattcctctatatatggctagccagctatcctagcaatatttaatgaataaggtgtcccttctctgttgcttatttttgccaactttgtcaaaaatcagttggttgtaggtgtgcagctttatttctgagttctctattctgttccattgatctaggtgtctatatctgtaatagtattatgctgtttgcgttactacagctttgtagtatattttaagtggggcaatgtaatgccctcaactttgttcttttggcttaggattgctttagctgttcaggccctttcttggttccatatgaattttagaattgttacacaatacacccatgtaacaaacttgcacatgtaacccctgaatctaaagtaattttaaaaagaaagtaatcgagaaacagagaaagggatatggagctttttgcacagttttcttgtttacaaaaagggaaataagatcattttcagaggaccttcagttctgatgttacctcacccagtgacttacagatctgtcctctctaataacgattctctctgaatagaagtgttcttaaggatagaacagcactgctgccacacaaactgaccatacacaggctaacttttggttccactttgatgaaaattctcagttctcggtttgcgctattcattcccttgactctgctttcacaaggaaatcattgataagaatctgtcgatcatgcttcaatgtagataataaagaaaaaaaaagccacagaaacatcctctttaaaaactggaaagacaatgttccttattcatctcgctggaattaatctgctaggttcctgtcctgttgctcaatcagcaggagaatctttggccaatgcttaggcaaaccgaatgaacagtggccatgctcttttgaaaccaataatactcacgaagtgggtgttccttaattactaagcgttatcttacagaacctggctagtggagtttccaaaaggaaaaatcccaagcatttgcttttgtatgttttcttatgttcttatatgtgattttagacacacagaaagtataccaaatgtaatcattacttctgtatgcataactcatcttaaggaatgaaatattacaagtatcatttaagtgtcctgttcatatcccacccaattcttttgtctttcctcacagagatagctcttgttctgtattcagtttatattaattcccaaacatctttctgcttttactatatattatatataactaaataatgtatatttctacatattttatcctttgtgtaaatggtaacacactgcaacatttaaggtgtttccaattttactatatttctcaagaagcttgatttttataacatctctttcatcgttttaggcaaccttccccttcctttttaaagggcacagcattagaaaacaaatggtgaattgccccctaagcctatgccaagtttataaagaacataactgatcttttggccagtgtaagaaactcttctggccgggtgtggtgactcacacctgtaatcccagcactttgggaggccgaggcaggtggatgacctgaggtcaggagttcgagaccagcctgaccatcatggtgaaactccaactctaccgaaaacacaaaaaattagcagggtatggtggcaggtgtctgtaatcccagctacccgggaggctggggcaggagaactgcttgaacccaggaggttgcagtgagccgagatcgggccattgcactccaggatcggtgacaagagcaagactccatctcaaaataaataaataagaataaactctttctttcggtatctatttggtttccctacaagttggaataattcatctcaatgctagtagtacctctctgaaggtgcatggggctgacttaagtattgctcacacaatgatggttgtctcattttattaattctgtgtattttatggtaggcctaaatgatagttgtgatgggaccttattgagaattttggtggtactggaaaactgcttgcacatggactatggccctataaataggcgatgaaatactattaaattaattaaataacataatctagtaagaaatgaaggaacagcaagaatgcctggctgctttggtggtcaccaacatagtttatattatagacaatgcatcatctggggcctgcccacagccacggtaaggaggtgaaatgagtatagagaatccaattttttttttttctcataaaaacttaagtgttagatcattgtggaagggcttgatttgatatgacagggatttttgataaaccgcattggtgacatgaatacagtaagccagaccagattgcttttgattttaatgttagattcatttttctcagcttcgtaatgtaagaaaaactgaattgaactttaaatatgcttatacttttctaatttaggataggaaatttcctcgattatataacacggctagttaaaaaccaaaaccctaaaacttttgtgtcacatgaagactttatgaaatatatattactatagattagtaaaatctgtattgtttttaaggtgacttctgattctccaattggagcaatacttccaaattctttgctaattttgatcttgaaaagtgaattctagttttctcatatcacaggaaaaactagtacatttagactcagtattatcattaaccagtatattaattttcatcacactcagtacttgatacttcatgccccctataaaacattctcacttcaccttttaaatgccatcatcaagtaagagagtactactgagctttattttcaatagcttttacagctaaagtaatagcccaactgtgttttcaaataaatacattcactgagagattgatacaggttcctagagaagtcaacatattttgagttgtcgatggtgagttttctttcttcaattatgcttggcacgaaaaggctcaatagccaatttctctgtgactggttcaaacccaaaactctatgttagcaaaaatttttagctattgaagccttctagtactatgacatacacatgaatatgaagccctgctttccaattagatatagggccaagtatagaaatgtgttctcagttagaaacaatctggcttctttccaggaaaaagatacagaaaatttttttctgtattcagagaaaataaataaccttcaaatctctgatgtctaattctacttaaaagctcagttgcaggaaagcatattcacagaaggttacatgatgtgacaattacgtattgcatgcctgtataaaaatgtctcctataattcataaatatatacacccagtatgtatccatacaaaattaaaaattaataaaatagagaatctgaaaatctgaaaacaattgctagactactttagacttctgctccaatattttttcctctcatagaattgcttttcctgaatggccctttagcactaaatttttctttttcatggagccatgttggtagaaaaaaataaacattcttattgtttattataagaatatgaatcagcgtgttatcacctttatgaccctcccatttattttcttctggcactaagttctagcaaaaagctaacatactactagtaaagttaaaattattttaattattattttaataatttggaaactttgggtctcaaaaatatgtttacttcttggttttgtcttttaggaagcttggcgccaatttgtggctttaaaatgttccctgtccattccaccacccatgatacattgtggatatatttctatgcaagaattttttattatttatctactataattttccttttcctagttttccaatttatttaggcttctcaagttgtgccatatgtatctcttcaagccacactaaataatttttctggaatttaatatatattaaatataattaagatactttaagataaaactgatactatttaactatagtcaatgtacttgaaattatgctttgtttggataaactaaaggtcaaaaaatcacttcatgagtaattgacatttttatgtatttgaatatttgaaactagatgttcaaatactttcatacgaaaataaatataatgttcttgggtcaacagaactgggagaaattcagcagatataaattaaattgtctaaaaattttttaaaataataaaaaagaaattgactctagatattcaaatttgctgcagtcacattccaaatacttggaatgatcggcaactacatttaatgtattgcatttaaatgaatttaatttagtttttaaaaatgtgacatttatcttttgaaacagcagatgaaacttatagcttgaattaagctctccacctaccaagaaaccatgagaaatgagaatgtactcaatagtcacggggtttcatatatgagagtttgaattttatgttaaaatattagaatgattatcataaatgtgactggcttagatctgcagggcatatattcttttatgattgttatttttaaagaaataatgagaaccttccaaataaattggtaaaaaaaaaaaaaagttctgtaattcagatgcaaatgaatatactttatttgacaactaagagattttagagtatgtcattaacagcttagtgtttgaaaagatctagatagagtgataaattatctttattctataaagaaagaaaataaatgccagttttctaagctttttttttttcctactagatctcacagtagctttgctccttgacgttatgaaaaatactttccaggcagattcaacaagcagacaattctccagactattcaagccttctatatgagaaggataacctagaaacctctgcaaaggtcattaccttataacatttgaatgatttcatggtgaggctaatgcaaaaatacctcaagtaatatgtttgaatgataagaaaaaataaggctaatgtgagttttaacctgtatatactgtatcttccttgctatagtaatctcatgtatgatcctgaataactataattcaatatcttatctaacattacatttattctgaaagagaagaaaaacaatttaattccctactatttatttggaaatattttatgtaacaaaatatattactacttgttctctgaatctacataaagacagttttcagtttgggtctcatttatacgattgtaagtttttacataaggtattgaaaatttcccaactttgaataatctggatagccacattgaattaaaaataaagtataaacgtcttatacatctagttaatttggtaactttaaaacattaagtgggtgtaaatggcctaacacagtggcaaattttgaggtaaaacatgttatcaatatcagctattttctttatatcaacacactttcaggtaatctggtaatgaataaacagtaaaaaaaaaaatactaagctatgagtctcttgactaagttctaagcagcatgaaatgattggccatcagagaaagggcaagaatttaacggctaatgattacaggagtcgctgtgtcatttggtgatggaaatgatagcccctgcatagacaccttgagattctttctgaaatgcgactttggcaatatgctaatcttgcaagtcctgtccagcccaactgtcttcaatctctgtgtccttgccctcttcatggctgtgggattcatctgggcagtatggtcttaggcaagccagtacattataggatctcatctctggaccaattttcagactaatgacctatgtatttcttaaggtcttattcataatttactgaactctaaggaagcttttggagagactcctgctaaagcttaccattggttttatcatggtcctgaaaagcacagattaatttttaagaaagggaatatgaaacaatattaatatttataatgctattattgctacatgttaatacttccttacaaaatcatattatgtgttttcacgtatgttcaaaataaccttcagtgatataggttttacctttccccaggcaacttcagaatccaaattactaggcattccttcaactgctgatctctttgtcaattccatatctgtagctgccagccattctgtcaagacattcatttcctttcgcatcttacgggacaatttcaagcatttctccaactgttgctttctttctgttacctgaaaagaattataatgaaatgtaatttagtttactctttaattcaaatttcgttataaccacttatttggaacttttatatttctgttatttaaaataactattttcttacacgttttaaaataatattttataaaaatcatatattctgaatattaagagtgaataaaaactgtctagggcagatgacatcgtttgtccaaaagatagggtcttgtatgtcgtcatggtagaaaagaaacctatacgaatttttctctaagataatttatagccaaagtttatgataaatacaatgatataagtcaaactgaagataaaactcatttctcactgaaaacttactgtcatgtgtcaataatatggcaagaaggtttacaatcctctatatacaagtgagactagctcatgctggtaaggaatcaaaatgaagatagaagattaattctctcaaaaggtaaaagtatttgtgtaatacctagaattctcaactgtatcctcgttacatctttaaagtgtctcacatctgctcaaaaacaatacagtgaataggtcacttcctccttaaacataattttgccatccaatagggacaaaaagatgaatgtgaagacaatattcattcccattaatagaaaaactaattacttgatcctgtgctcctgttctcagtgtttgataccaacaccctcaaaagcaaattatccatattctcacataagaaatgaacaaatctgtatttctccaccaccttctcagatgtgcctatattttgttaagattttcagttggttggtttaataaaaatcccagcatctctttctactaaaggcagtcaaatcatcaacaaaagccagataaattacaatttcttaaaggcaaatcttcttgcctcacacatctttagattactcctctctactcctgaaagttccttgaacaaagaaaggtctcactaaatatgctttatgtattgaataaaggaatgaatgaagacttgcaaatcgttaattacaagttagaaaatataactggtagaatttacataaagagtttatactcttacaagttgctcctggttttcttttctttggtatgtgttttcacctttttttaaaaaaaacccttgtctgtcatgaagcctgggaatctgaacaatagatataaatatttggctctgcagaaacagcatgatggaatgtaagtatgttaggctctgcgatacgtagtggactctcgacttgagtatgatttttggcagaacacctcatttttctcaacacatctgtcaaatgggattactatacttattaatagaacacaggaatattgcgagggtaaaggcagacaacagtttgagagagcatgacatattgtaccacctcaatcccttcctttattctcattatttacctttagggatggttcaataaaaaactgtgcctgaatgtatagagcaaaagctttatttacatttattttactaccttacaggtaaataaaacatggacaagatttggcttttgttgctaagaaatctgaaaggtagactccagattaatttcaattgtaatggaattggttaaaacaataccaccaccacaagtgcgttatttgtgcattatgccctaagcccaataggcaccactgactgatacatatatttatgtcatatatatgtgtgtgtgtgtctatgtgtatgtgtgtgtacaaccaaaataagaatctatctataagcaagaaaaacacaaaagataaaaatatgtataaagcatctaaaatgctacaatcgaaataaatattctggaaccttgataacaattccaattccaaataataaaattccttattttctttaggagaggtgtgcgtacatttagaaaacatttagttgctgaggctgtaaattcattttttaaacagattttcccttctatttttttttttcctaagtaaaagcatctgcccttttgactgcaagaattttgtgttgtaggggtgtgtggggggtgagggaaaatatactttatggtgtgtttctatgcatatttttcctatgcattattggtagaaaaatgattccagattcaatatttcaaagaaattctatcttcccagagctaatgcagtattgatttttatttatttcattttgtttatttccagctaaatacatttttaaaaaacaggagacactgccatcttaaggaaaattgagttttatactttgtgtgtgtatgcgaggaatggatacgtttaacacaatgccacctgcagtaaaatgttttagtagtcattgtttcacgaagttaacaatgtatttaagggatgatattagtattgctatttatgtaaatttccataaaaatcagagcatagagaaataaaaaggggttataggtattattacatcaatggtgccagctttaatatctcttaataaattaattatattttctctccccactcatcaccatgtaagaatacagcaaaaaggtaagacaagaagaaagctctcctcaggaatgaaatggatcagcaccttgatcttgcactcccagactccacacttgcagaaatcaatttacctagtttattttattgtgttatggcagccagagctgattactccaaaaaggtaatgcatactcaattgtggcagacacaaccatataaattctgaagatggttaaaatagaagggttccttcttacataaaaagaataatgtaataacatttcctttgttgcctttgctttcattagacaaagctactgctgttgaaaatattttgagtcaaaatccagacaatatttttattctcaggcaaagaatataggacttacagcatttttataagatggtatttatacatgatcccttagtcacaaatgtttctacatcaatatttacttcaaaaataaatgtttggcctatgtttttgctgtattctgtgatactattaaagttaaatatgatttcttcatacacttttattttgctttaaggatattactatgtggcaaatggttagaataaacacaagctctcagatatgtattttcaggaataaatagggtttgacatcattacgagaatcattcatttctgaataataatcaactcagggcactattattcgtctaatgtcactttcattgctttaaattctaattgatttattctgttattttatgttaaatttactcttgcaatgatttcgtaaaaattcctatgacaaataaaaagcccacacacaaaaaacctctattttaaaaagtaaactgagaaactcccctttaccaaaacatatattttcttaatttaaaaaatactcatccatacattattttagtataaagtcacacaggtcaaattataaactgaaaatttgtaatttataactataacatacattcattttattaatttaaaatttataattacaaaaacaatatatctccagaactgaagctgtagcattaggattaatattagagattattcaatctctaatacatttgagactagagattactcagtccttcgtaattgatgttaaatatgaaataattggcatctataaaaattgataagcaccggaataaggtatcaagtgcagatacaatttttctgtctgtggtgatctttaaacaatgataaatttctctagaggatataaaggtatctcattccaaaggtaccttggtagaccaaatgaacagttgaaatgtattttatttcaagattatcataatgctttcccatcaattgagtatcagtgtttcttattttgaaacaaagtaggagaatcttttgtcataggatggcaacaaacttgtttaaaacataacaaatattaattagagggtttttaaaatataaaaacaagactatctaagaaaaatgattacttccagatttcaacttaattataaaatttactttctatggtaaggaattggcaactaatatcttgaagatataaccttcaatctactttcaggctgagatgcaagaaatatgcctctccttagctatttctcaaacatggacattcatatttctgtctaagatgaggtgacaattttatcagtgatgttgttctattcactaaagttgagaacctgagttgtaaaaatataactttttatcctccaagaaattcagttctttcagtcagaacgaaattaaaatgttagaagtccatttttggaaatactaagatatccgtttatggaaagatatcccatattcatggattggaataaataatattgttaagatgtctgtaccactcaaagcaatttacagacttaatgcaatccctattaaaattccagtgacatttttggcagatgtagaagaaagaatcccaaatttcattttgaacaacaaaagacccagaatagccaaagcaatcttaagccaaaagaacgaagctggaggtatcataattacctgattcaaaaatattctataatgctctagtaattaaaagagcaggatggtagtataaaaacagacatatagaccaaaggaacagaatagagagcccaataataaatccacatatttatgatcaactgatcaaccaaggggccgagaatacacaatgaaaaaaggacattctcttcaataaatggttctgagaaattggatatccaaatgcatgaaaatgcaattggacacttatctcacagcatataaaaaaccagttcaaaatggactcaagacttaaaacctgaacctataaaatgatttgaagaaaacaggaaaaagcttcctgacattgttctgggcaaacattttttttggatctgactcccaaagcacaggcaacaagaggaaaactagacgactgttatcgcatcaacctaaaaagcttctgctcagcaaaacaaacaatcaacagagtgaagagactacttactatcataatctatacagaatatttgagttgagcgaagtgagatggagagatataggcatcttgaattagcagtgaagtggagctggtcatgagactctgatcaggacaatgatacaaaaataattacagagacgtaggtcttaactggctatccatgctatcttattagccaagtgtggtagattttgcaagtcttggccatatagggaaataattactgtgtaatttttaaacttaatgtggtctctgtggaatatgttaacaacattagacctacatataaatagatacagtttataatatttaccagtcttcaagtcatcacaagtagatatatataatgaaaataaggaacacttacaactaagaaacccttttagagctatctgatggaccaggaaaaacctccctgagcgttacgtatttttcaatctgaataagcagagcctcactgattaattattgtttcttaatgagaattccacatcgaaatatgtgtatatgtttatctttgtgtatatgtgtacatatatatatatacgtatatgtgtgtatatatatacgtatacatatacatagagagagagaggtgtttagaattgctaagactctaatcatacataatttattgcccgttgctttacaatttataaggaaagtggaaagaagtgtttgtggtctcagcatgcacacacctttgctcccagctcattataatgcaatttcaaagctgttactctttcatcaagttctttgggattttccgtctgctttttctgtacaatctgacgtccagtctttatcaccatttccacttcagacttcacttcactcagacttttatacaagttctaagtttaaacataaaacaaaacatgataatcagtagagttaaattatttcataatattatgaacagaaataaatagagatccccttaattgctattccatgtttgaaattttaatagagtagcattttgcagcggtggtcaatatctagcttttgcattttctgttgatttaatatttctaattgtctacacacatgcatatatgtgtcatttgcagctattcttattaaacagagagttaatcatatatatgtgttttgtgatatatatatatttagttcttcaatcaaagaacataaatgtcaattctgaattttacatgacttctattttaaatgttggagttatataattctagccataaatttggatgaattaattcactcctacatcgggtatttattgagtggttactatcaatcagatagtatttgaatcactgggaagtcagtggtggccaaaacacacacattcactattgttctcatggtacttacatattagtaacattaaagcacctaaatttctacatcataatttcaatatatattgtatcatatataagaaagtaaggtccttttcaatgttaattaaattacacaactttattttcttaaaagtgctgatgaaaaccagatataaaaatattattgacaattcacatgtacatcacaaatataaagcacacacatacggtttcacaaaacataggttgctataaaaaagcatcataagacaagtgtcataactttggaagacagctatgttcacaattataccaccaacaccactccaacaccacttgatgtcttaattttgctttgtagttttcctagaaatatatgtctttgtatgtatgtggccatgtattcaaatatatgtacgtgtgtgtatatacgtatacacgtatatataatagtttacattatgtatctctgctttaatttgtttagtcataaatctgaactatcagtacttattttagtattaccaaaaaataaacctgacagtaggtaattgtttttatggaattagaacaaaaattgggtttaatttctcttttcagtttaaaagtaatgtctaaaaaaaagcattttgtaaaggctggacaattatctgatcaatgctacatgtatatttccatattaatcctctttgacaaatgatgttaacattccttcatcactaataattatgacttttgtctgagtttcccagatgatattatttacttcattttacttttttcttagaagatataaaaatatctgtgtatctggaaacactgaaattaattattatgttggaaatcaacgatgctaatttggaatcagagatttttctaaattatttactctctgaacttcaaaaaatataaatgctttattttgatgaagaaagttccctcaaggtaccgttagccattaacattgtttcattcaataggcaagtaaaatatttataaacaaaggggagaaatattatttatatttgtgttcatgaaagtaagacttttataaatagacaaacatgtcttgaaggcaagactatgattatggtatacaccacaaagcatcgtaaacaatgaaaaaactaaacagtgtaaggatattcttatgaaagaactgcttcaattggtcctgacatttaaaccagaaccagaaaccaattgagcaaatgccttgagcagtttcctttgtactgacgcagggcacagtcacagcttgacacaggtgagattgttttcagctcatatttactgttggatacattttataaggtaacattagagacctgtttctagaaaagaacgaaaagtgctcactttgcaaatattagtcatgaataaggcacttgggtcatttatgctttccttttttttttttttggcaaaatttaagatgggatatgttcccatatattcctatccttactcatctaatatcaactaactactttctatcatttctattccaagtttctttttgggggtgagaataattaaagtaattataccactaaaatgcagcttgaattatgaaaatatattatcgaataagaatacctcatatttttcacacataaatatatgtatttattttaagatatttgttaaaaagaaaaatatttccccattcatgatatgactacgatgtatctgaaggactctgtttttcattgatattatggagtagatgtagaaacaatacttaaaatatcaagtactaaatagacttgttttccctttaataacattctgtgttttcattttatgtgacttcccactctaatggccgatagtacatgtagagttataataatacttatgttactcgagtagatgcaatcatacctcagctttgttttcagaggaatcatctcagttggtgagtttccaataacagcaacataggacaccgttcaatattataaagtttaaatcagatttatactttaggctatttgtacctttccatgccttttaattcggtgttgtcttgaggcatttcactgtatatccagtactggtgtttaaaggaaagttattaaagtttggaataagagtacctgaattggaatcttgctttgccattcaccagctgtttgtccttaaattctctcaggtaatctgtagccttaagaattaaaggtgacttctgtatgtcacgtagtttacctggcatccattatttctgaagttgttaggattattgcaactactgttgttgttactatttttagattaatatatttcctttctagatttccatttaaaatatatttaaagaatcataaaaattaaacacaagcaacatccttttatattctgcacagttcttagcagaattatagactcaaaaaagacacacagaataggccacaatacatgtgccaatttttgttctcaatcttaaaattacatagtataattattatggttatctgaaaacaattctctcttataaaagagcagttacttcttaatgaggaaagtcaaggggtacctgcgtatttgccaccagaaatacataccacacaatgatttagctgtgactgtactacttcctgttccacactctttgtttccaatgcaggcaagtgcatcttcacttcatctaaaatcatcttactttcttgtagacgctgctcaaaattggctggtttctggaataatcgaaacttcatggagacatcttgtaattttttctgtaaggacagtgtaaaaaggcactgatttaattttgcctttcaaacaataactggtcctatttttattgatagatctgcctttatttctgaagatatacagaaaaataaaaacaaaataaagcagtatttttccattcatccaacacaggaaaacatacatttgggagaatgattcagtagttttttcttaatgttatactaaataaaaggtaatttattaacctattttatctttaaaatgtagagagcaaaacactcattgtttagacatcaaattatagttttcaaataatgtcctcaaatccaatcttgccaataatcaagttgtccaatatagactggagtataatgcccaacgaaaacacgttccttagtttctgaaataacatatacctgtgcaacatcaatctgagacaggactctttgggcagcctccttcccctgattatgtttcttcatttcttctaaactgatctcatgacttgtcaaatcagattggattttctgttgggaggatagcattattagtcagcatgctctacaaagaacaactaactttccaagaagacgaaattcagaaactctcctcaaccacctctaccatgtagcttcctttaaaatgaccgtaaattggccaagagtggtggttcacacctgtaatcctagcactttgggaggtcgaggcaggtggatcacctaaatagaattatcataaatattttttactttcataaattatccaagtgaaacgatttatttcttccctatgggattattatgaaaaaagcaataatcattttgagtcaatatcaactatttcagatatcattttcaataggtaatttatatattatatgtagaattgatatgttttatctttgaagtcacactcaaatcggaccaaagacatgatgttaatctgtaagattcagccaactgtgacagggatgagatataatgagaaaattgcatgtggaaaatactccttaattaccttctttttattttattttattttattttgtagaggcagagtcttgctatgtgacccagcctggtcccaaactcctggtcttaagcaattctcctgtctcagcctcccacagagctgtgattataggcgtgagccactgtgcctggccttagtgtagtctactcagtcattatgtgccatatttcagttaaatttcagggaagctatgaatctaagaaatggaagtcaaatgccccaaacaggtattgctatttgtctgatagatatttgatggcttccggcagatactgattgtgaattttagataactataaaacatttcaatatttatatattcaataaagacattttcgatcaagttctatagtaaagtatattctgcatttaacatatgaatttctgagccagttataggcagggatctctgcagcatgtggacacgaacacaatacatttatttatttatttctgtcaaatccatacaaaatcagctagcggtcaaatcattctaatttaaaattcagtcattattagattattataatttagagcagaaactaaattataccagagtgcccataacattatcatgcagatcattttgcataacgtatattagtgtaagtgaatttacaccaattggagtaaattctgatacatatcattagaagataacatcagttttgcttagcagtttccagagcgaactatagccctgaactgagtaatgagaattataccaagaacatggactaagtggttaaggagctccttatgcaaggttataaattcacagatgtacctcaatattattccttagaatattaatcctaacaattatagaggcaaatcaattatgaattacctaaatagttagaattctgccttaaaacaaatgagagcaaatacgcatataaatgtatcttattttattaccatatcgatgatcttcattggttgaataactaccttgtgtgagaaatattgatatgtttcgtgaacctagaatctgggagtagggatccatctaggtgcatgacgttatttatagagcaagaaacatcacagaatctataaaattggatggaagtatgcagggtggagtgatgcttgtacggaggatgtcataagggagttgatgttaaagtagaactttcaataattagtaagcattgctgggagtaacagatgctttagaggggttatggctagggcctttcatcttggaaatgttaatcctcctcaaaaaggtgggccagtaacaaccatgtctgtgccacgtaattctggccaactccatgttatgggtgatcagaatacacacaatgcttgtgttaagagagaatcatcagaatctctctcagaaaattagaattgacagaagagtctggtcaaactgtgagtgcttcgaattgtgtcacatatactagcaaattgtgcttacgaagtccctagtttgcagagtggattgaggaagagcaaaggtccatgaacagagagagaagaaagaagtagatgcatagggagtgaggtggtaacaaaaacactgatggcttccaatgcggtatggctttatttatttatttagttagttatttatgttttgagatggaatctcgctctgtcacccaggctggaacgcaatagcacgatcttggctcactgcaacctccgcctcccaggttcaagcgattctcctgcctcagccaaccaagtagctgcgattacaggtgcccaccaccatgctcagctaatttttatattttttagtagcgacagggttttaccatgttggtcaggatggtctcgaatgcctgacctcaggtgatccacctgcctcggcttcccaaagtgctgggattacaggtgtgagccaccgtgcccagcccgtagatagcattttcgaaagagggctgcaataatagctcccacagcacatgctcctcttaccactccctcaacaagaggtgaagtttatttcttcagctctttaaatctgggttgactctttgactgctttgaccaatagaatatagtccaagtgccagttatggcaaaagtccttaagtggcctggcagcttccacgtctatctttttagaacagtcattcttagggtgctcccttttagaatccatccaacatattatgctctgagaaagctaagtaacatcgaaaggccatggataagtgcttcagcaacaatcacaacaaggctttcagccaacaactgctaggcatgtgaatgagtgatcttggacgttcagcccagttgagcattcaggttactatagtatcagacaacaatggactaaaatcacataagaaaccacaaaagagaaccatccaggtgagctttctcaacacgcaaaaccattagtgggaataataaatggctatcataaataaccaaaacacaggcattagtcccttcttgagtcaaaactttattactgcccttggattctatgacacattcctgtttccatatgaaaaacctttctctctcatttgttttgctttagttacttcaattttgttacttctaaatgagagtcctaaatactgtatatgcatactggatacgcaaggatataggagttgtaaaaacaaaagcatttctggttgaagagagacaaggtgtggagacagggcactgaagagcataaggagtttggcaaaatttaacaagaaatgtaggtagaaatcaggtattaaataactttatgtcccaaatgaatggttaccactattttgatcacgaagataaatttcaaaatttgaaattgatcataatcacagataacagtagttttattgctaatatttgatccgataactaaggaaattcatagggaggaaatgcgactgtaaatcagcagtatgttgaagtgagtttgcattttaataatcactatgtgtgtctgtacagagagaaagagggaaacagggtacatttgtataatatgtattttttcagtgttttcaagcgttagaggaaagcagaaagagagaacaaagagagaaccatggagaacacaaatttaactgacatggaaagaaaagcaccaaataaagagaaagaacagtcaaagagaaagaaaagaagaactagaaaagagagaaaatctcacatcaattgatgtgagaattttaagaatgagagagagaggtcaacagtgacagtttgagataggttcaatgggatcaatagtaatcagggtacatgagctcgtcaatgaccattgcagctagaagagagaagtggatgacgagagcagaaatcgtattttcaagggctggcctgattaaggatcaaggagcactctaataaaaatagtttaaattacttttgcagacttttgtctccacacataataaaattcaggtcaatcagacttgaacatactttaaggctacatgaaagaagccaacacataaagtgattttttttaaatgtaagaagataaacttgattttaaaaaaacctgtttaaagcaagaaaaccagagtgaagcacaaagctcagggccaacggaaaatatcaacaggaggagaggtggctctttttcagaaaacaaaagtaagatgtgaagacgcaagaagttgaatgcttcctacatggtgctctcagagtatcagggtgaaatcatgttaacagtaaccaggatttaaatttcagggctctctcttgccaccttgggcaaagcatcaacatgttctgaaccttgattttctcatgtctagcccaagaatgataatagcaagccagcaatgaagttttcttatctgagaaattctcatttcttcagtagtcaactacattggttttggtcaaaaagatcagatgtgacagtatatgtaaaaatacctgtccatgttatttgcacaaatatttagttataagttatcagcgatataacatgtcatttcctcgtaagcacaaaaccctaggtatctgctgaggatgagaggagagaatcaaggtggaatttaaatcaaagtgataaaagttcaatagcaattgtggagactgtgaaaggaaactgatttaaaaaaataagaatacactcagagagggtagagggcccaaattatacatctgtaatcatatctgtgtacatgtatttaaaagtttttccatccccttagcctccaaggttagtagaggaaaaaatgaagtatacacatagtcctttaaccttttataccagagtggtcaaagaagagcaaaaaacaaaaaaacaaaaaaaaaaaaaaaaagaaaagaaatcatcatcagtatcctcaccaccacagatatttgtgggaacttatgtgctaacactttatataattaattccatctcctaatcatattaacataagtatttatcatcttcatgtacaaatgaaggtagaaacatcaacatgcccaaggtaacataactaggaagtaacaaacttgctgccctctaacaattatactgcctctttaattatgattttaaaataaaagtatcctccaaatggacatttgtgagaaaaaaagaaatttaatcttattcgtatgttgatagcatttagtcaatttaattcaacaaatcgttcagcttctactactcaattccacacagtgagaacaaaattgttgcccctatacttacagaagccttattttaagaggcagactgtagatatataagtaaattacaaagcagaaatatatgcaatgtaatagaaaaactaacatcacacaccagggcctgtcgtggggtggggggaggggggagggatagcattaggagatatacctaatgtaactgacaagttaatgggtgcagcacaccaacatgtcacatggatacatacgtaacaaacctgcatgttgtgcacacgtaccctagaacttaaagtataatttaaaaaaattttaaaaacagaaaaacccatgctctgtgatcagaaagataaatattaatatctgctgtataatctggtgatttttaggaaatttacatgatttaactagcatatggctgagaaagggttttggagggtcagagaataagaatataggatcttattttaggctgtaggaaacaagctagcaaagattaggcttggggcatgcagagtgtgtgtgcttaatttaatgggaggaaagactgaatgtgagttagtaagaattactatctagatgaggaattagtatgaagctacagaaccttaagtttcagtgcctctcacttgcaagagacccttctataaaccagcatttaattttctatttataattttttttttcaaagactgcccctggaaattctagaagctcagcattacaaagcaaagcaaagatagcgtaagtgatcactgcaacacaggccttcctgataagttccacattttcccaaatgagtcatattgttgtcataagtcataaataataggaacaacaacagcttacatataaccaaacactcgacttttatctgttggcaggggacatgaaggaccaagtaacctgtgagaggaatgttgggcaatttggagctcaaggcaaagcattccatggaatttgaaatatacatatttccattaaatagttagaaaaactgttgaggatgagcttctgtgtttttagaaaggtcgccaccactaaaattattaacattgaaaaaaatcatcattgaacatcatataaaagtgagacttttatcataatgtataggcatttctagtgaaattcgcatatttgtagtactgttccaatatgattagagataaaattttctttatgcattgagtagattatgcattaaaaagaactcagtggttaaacatattttggaaattgaagatgaacatgtgtctataccacagaacttctcagaatatttattaatatatattgtgtatatccaagaatcatacaacactttgtagatgttatccttttgcttttttttgccagagtgcatcatacaagtagatttggaaaaaggctatcaaatatacttaacatattcattaataataattcaattcattactaaaattataaaataaaatgtctttatatttccaattgattctactatgggtaagctgtaaaacatgcatgacacatatttgccagcatctttacacattaattccacaaaatttacatttaaattgtaattaacttttagcttgtacttaggatatcttttaccagctactttacctaacctcgtcagaactgtattctggaaccacataagtaaaaaatgcttagcactttagcgcaggcttattgtgaaatagaaaagtaacttgtacaaataacagaatattattgaaacttctgggaagaacaatctcctatgtaaaaatcactcataaaaaaagacaatgtaatcattttcttttttgacattatgagaatatgatgaaagaaaataaaattgtggaagaaaacattggggatagaagattcaatctgaaggaaaatgatctctctacttgtctactagatttctaagttgtcctaaagatgtgagggatgtataatttgagttatattttcacctaatatatacatctagggggatatggatagtaagcatttgaagaaaacaaataagccaaccacatacaactattcttgtgaaattatcagcctggcttcgtataaaatcagtaaactctaatggaaacaaagtgagaggacatagcaaatcacggatactgatgtgaacactcacatatgctctatgaggtgttctcaatccagtacctttcagaatcactagattttcttcatcaaagtcaagtaatataaagcaaattatatcatctttccattatattaaaaaagacatttgagcttatctcaacattccattataaaaaaggcatttgagcatgcagtaactatgttcacagcactatatattcaaagtaggaaaataaaacaagtgaaatcgaattaaccatttttccattgaatatggtaaagggcaaaattatagaaccaaaaaatcattcaaacattaatcacattttaaatataggactttacagttaactgagcagagagcagggctgtttttaaaatcttgctttacctcatcaaaccattctcatatatatagtaacagaaaatggccagcaaaattatactgcagcaggctaaagtacttaacagaatgaagaaaatgatatcaaataattattggagtttctgtggtgtcaaagaaaggaaaaatttagagaaaataagaaaatattttagtaaaagatattaaaatacttcatgttgagactactgattgatggaggaacgtaccactgttagattagtaattttgaaagagccagtaattttgaaattgctattttcaagaaagggaaatggccacatatcacacgtacttagaaaacgaaagaaacaaaatatatcaaaagatttgggatgatatgtactttccaaagataggaaaatgcaagaaatataattattttcatagaaaaaaaatgttgaaaagtttcaggttatactttataataattcaacaagtaaaaaaagaagaaattcacacagctttgtactactctttttttaaacccccccccccaagtagagttacttagaaaaatattacctttaaattaaattttgtcagctaaagaagttttgacttttatcagaaatatgcaataggccaaaggaaacagtctatttcagtgtctcccctacattgttccttgacatatgagttttgtggtatatcaacatatttctggaggaaaaagtgtctgtggcttcttatcaaatttaggttaaacttttatttttgaaaatacaaaaaagtgggtcaaaaatctccagcagagaagtaaagcatataaatttttctgcgtaatcttgaccacagaaccgtttaaaaataaaaaattggacattgtgtataattattacttgtaatatacctgagaaacgatgttacgcttagtcataataacgacaacgataatagaagagttcattataataatgtattttctaacaaagacattcttcacagaaatagaaaaaacaatcttaaaatttatatggaactgcagcagacccagaatagccaaatatatcctaagcaaaaaagaatgaaactggaggaatcactttacctaactttaaattatactacacagctatagtaaccgaaacagcatggtactggcttaagcgcaaacacacagcccaatagaacagaatagagaacacagagataaatccatacatctacagggacctaatttttgacaaagtgccaagaacacactttggggaaaggagtccttcaataaatggtgctgggaaaattggatatccaaatgcagaataaaaccagacctctatcttgaaccgtatacagaaatcaaatcaaaatggattaaatacttaaatctaagacctcaaattatgaaactaccacaagaaaactttgggagaaacctccagaacattggtctaggcaagaaattcttgaaccataccacacaagcacaggcaaccaaagcaaaaatggacaaatggtaacacaccaagttaaaaatcttcttcacaacaaagcatacaacccacaaagtgaagagacaacccatggaatgggagaaaatatttccaaactacccatctgacaagggatcaataactagaatatataaagagctcaaacaactctataggaaaaaactaataatctgattaaaaatgggcaaaatatctgaatagacttttttttgaaagaagataaatgacaaacgggtatatgaaaagggtctcaatatcactgatcataacagaatagtaaatcaaaaccacagtgagatataatctcacttcaactcaaatggttttatttataaaacaagcaataacaaatgttggcgaggatatggagaaaagggaaccctcatacactgctggtaggaatgtaaactagtacaaccactatggaaaacaagttttgagattcctcaaaaaactgtaaacagagctaccatacaatccagcaatcccactgctgtgtatatacccaaaagaaagaaaatcagtacactgaagaaatatctgtactcccgtgttttattgcggcactgttcacaaaagtcaagatttggaagcaacctaaatgtccattaaaaaacgaatggataaagaaaatatggttttctagatatacaatcatgtcatctgcaaacagggacaatttgacttcctcttttcctgattgaacaccctttatttccttctcctgcctaattgccctggccagaacttccaacactatgttgaataggagtggtgagagagggcatccctgtcttgtgccagttttcaaagggaatgcttccggtttttgcccattcagtatgatattggctgtgggtttgtcatagatagctcttattattttgaaatacgtcccatcaatacctaatttattgagaatttttagcatgaagcgttgttgaattttgtcaaaggctttttctgcatctattgagataatcatgtggtttttgtctttggctctgtttagatgctggattacatttattgatttgcatatattgaaccagccttgcatcccaaggatgaagcccacttgatcatggtggataagctttttgatgtgctgctggattcgttttgcaagtattttattgaggattttttcatcaatgttcatcaaggataatggtctaaaattctcttttttggttgtgtctctgcccggctttggtatcagaatgatgctggcctcataaaatgagttagggaggattccctctttttctatggattggaatagtttcagaaggaatggtatcagttcctccttgtacctctgcagccaaaaaacacatgaaaaaatgctcatcatcactggccatcagagaaatgcaaatcaaaaccacaatgagataccatctcacaccagttagaatggcaatcattcaaaagtcaggaaacaacaggtgctggagaggatgtggagaaataggaacacttttacactgttggtgggactgtaaactggttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtctcacaatgatacaatggatttagaaaatgtggcacatatacaccttggaatactatgcagccataaaaaaggatgagttcatgtcctttgtagggacatggatgaagctggaaaccaccattctcagcaaactatctcaaggacaaaaaaccaaacactgcatgttctcactcataggtgggaattgaacaatgagagcacatggacacaggaaggggaacatcacacaccggggactgttgtggggtggggggaggggggagggatagcattgggagatatacctaatgctagatgacgagttagtgggtgcagcgcaccagcatggcacatgtatacatatgtgactaacctgcacaatgtgcacatgtaccctaaaacttaaagtataataataaaaaaaagaaaatatggtacctatacacaatacagtactattcagccataaaaagaatgacgtcctgtcatttgcaataacatggatggaattgtacgttattacgttaagtgaaataagccagtcacagaaagacaaacatcccatgttctcagttatttgtgggagctaaaaattaagataattgaactatggagatagagagtagaaggatccttactagaggctgggaagggtagtcaggggttggggaggaagtggggatggttaatgggtacaaaaattagaaataatgagcaagacctagtatttgctagaacaggatgaccataataaaaaagtaatttgagtctacattttaaaataaactaaaagagtacaactgaattttttatatcacaaaggatagatgcttaaggtgatagacaccccatttaccctgatttgattgctacgcattgcatgcctgtatcaaaatatctcatgtaacgtttatacatctactacgtgcctacaaacattgaaaatagaaataacgtattttcaagtaattatggttacttttcaaaatagataaatgagtaaatcaaactctagggaacattttggaatgctgcctagaaataattgggagattgtacttctaggttaattttcacttaataaagggctaattattaaagtggagaaagcagatctgagttaaaatatcagcttcagtaaaaatgctttagcattaaaattcattaaatggaatagaatgtaaacaatgggaacattatgatattactatgtaagatcttgcggacatcagtaggccatcaataaatatctaccatttaagttaattccaggttatttaacaacattcatcacatttcaccctttgctatgcatcaaaataatggagtgaaaaagttgatggtaaccttaaattatctttttaaatatataatagtaattgatatattctctattcaatagggttttaaaaacaactttgaggtacaatttacataccataaaattttcattttaaacatatagtcaatgaacaataggaaatttatagagtcatgtatatatcaccacaatccaactttaggacattttttattaacccctaaacctgtgtgtccattttcattcacatcctgttctcaacccatgcctcaaccattcatctagtgttttcaaatattcccttttaaacacaacttttatacttcattaggctgctgtaattaccaaataacgtgaatgctttcaaaatattagatattcacatggtataatccttaaaaactaggtaatacataaagaggctaaaatatatattttccatcagtctttccttttcatgtgaagagttccattttatactattcaaagtattttggaaaggttttcagagcttcaaagttgggcaatcataaggcattatgacaagaagtctttatgatactattaagttccattggaaaaatggttcttcactattatggtaaacgtaagtggccagcaatttctaaattttatctttctttggtgctatctaatgagtggcaagatggcaaggaccacgttaggcttattcacattttaaattttacactgcctatcacatttgtctgacacatacttagtgactaaacctcagtggaattcaataaatttgccagctatttgttagaaatctgctgggtggcccacggtcttacagctgaactttagtggttagagaatgggaatagacggggaaaatttttaaaaagcaaataaaagatttaacaatcacgataaacgctgaaagaaaaataaaacatagtatgttatgctaagtgttatctggctgtgcattttagatcgataaattttctgtgtgctatctttgaagtaaatattcatttgcataagacaaaattgggaaataataggataaatttggatcacttcaaaatattcagagtgttgcaatagtgttcactgtggctgtagcgtgaagttattagactggtgcaaaagtaattgcagtttttgccattaattttaataatttcatccttatatgtagaatttgtagatagatttttacaaaagcatactatagtttaattgcagtcttaaaatgtacacatcaaaataatatgaaagaaatctatatctttatcatatagccagtgaggacataataatgtacaggttgtccaagtacagtcagtgacgtgtggcaagtttctagtattttacatttcctacaacttgtgtttatgactgtttcccacactattaaacatatgaaactaacaagttattcttaaatggagagtaataagttctgtatagcaacacataggggtggcctttcaatgttagaacagattcaaaattaaatgcactaggtttaccatctactgggctgtgtaaaaagaaaataaaaagtctacatctatggctagataggttttaatatttgaacccaaatctctgggttagttctccatttttttcttctttgactaaattatccaattaccacataaattcccctttgcaggtttctgctgtctaactcataaatcaataaagcagactgtaaagttacactgttccaagtcgtttggcaatcaaatatgcctatttacactataagagtctgttttattccttaatgaaatcaaaagctcaatctgatagaccaaaatctgcagttatatctttatttttaagccattgattttgatagcttggaatgttaacatttaaagatgaccgattatatttaatgtgagttataagatttagcttctttgataaacacgggaagattgcaattacgaattcttcttaaagtgcatttaacgtaattagtttaaattaatagctttctttgctttaaaaatcccctcttttctaaattgtactcacattgttaatgggagggaaaaagagaaggaggaagtctggtctgtagtggactctggaacacctgacgtcctagcttggtgagcaaaccacggcagtatttttcaatatttaattatgaggcactcttctttgaaggtaatttgtttccttcctctattcctgctcataaatctactatgtgggacacgaggttacaaaaaaatgagatcagaattctttgggaaaaaacaaatagaacagtaaagctactggagccactgctaagcaactccgctcttgcttgcagtaatttaagcaacagggccatgttttcccctacaaaatgtgcatcaacacataaggacatggtgactttcaacaggtgcccatgttgggttgttcttacatatcaaagattcaaaactaaaattagtagaaaaggaaaaaaatcatgtatgtgaaagtatctttgtaattttaaaaattgcaagacatttaagtagctatttaaacatagttgtcactgtcccctaaaatgattaagagccatatgcaagttaattgacatgttaacaaatggggttagaaaaaaatgaattgaagaaagccaagcagagttcagcctcaaacatctatattgaacattctttttgtctaaattaaaatttgtgcgatagctctcagctatattttcttccatcacccattttccattagaggaaaaaatcaaaataggagagaatctcaccagtagtttgattgccactctgactccctcccattgaaacgttgacacagtcatagaagagaatctttatagaagagtgatagaaaatgtcgtatgaaaaatactctggaacaatttagtcattactagtagggaaccatccaaagccattctccaattagctacacattagaatgaataaaaaagtttccaaaaattctgaagaccaaatccacctaaagatttgatttgattgctccggggctcagcatggttacttagactgttgctataggattttaggtgccaaaactaaactctgtgcttcaatatatagttctgaaaaattgaacagtaaatgactaaatttgttccatgtgtttctttgcagtcacacaatttcgtgatttaattttttatttatttccaaggaacacgcataggttgttacatttttaatcatagtactttggaaataatcctagtttctgttttctaagatatatttccatatctagaagagttttccccatttgctttattctgtttcaataaatcttttcttaattttgtactttaataaaatctctcattaaatgagctgacactgggtagattgatgctgtggccatataatttaatttaagactgtggtaccagtaccatgctgttttggttactgtagccttgtagtatactttgaagtcaggtagcatgatgactccagctttattcttttggcttaggattgacttggcgatgcaggctcctttatggttccatatgaactttaaagtagttttttccaattctctgaagaaaggcattggtagcttgatggggatggcattgaatctataaattaccttgggcagtatggccattttcacgatattgacacttcctacccatgagcatggaatgttcttccatttgtttgtatcctcttttatttcattgagcagtggtttgtagttctccttgaagaggtccttcacatcccttgtaagttggattcctaggtattttattctctttgaagcaattgcgaatgggagttcactcatgatttggctctctgtttgtctgttattggtgtataagaatgcttgtgatttttgcacattgattttgcatgctgagactttgctgaagttgcttatcagcttaaggagattttgggctgagacaatggggttttctagatatacaatcatgtcatctgcaaacaggaacaatttgacttcctcttttcctgattgaataccctttatttccttctcctgcctaattgccctggccagaacttccaacagtatgttgaataggagcagtgagagagggcacccctgtcttgtgccagttttcaaagggaatgcttccagtttttgcccattcagtatgatattggctgtgggttcatcatagatagctcttattattttgagatttgtcccatcaatacctaatttattgagaatttttagcatgaggggtagttgaatattgtcaaaggccttttctggatctattgagataatcatgtggtatttgtgattggttctgtttatatgctggattacgtttattgatttgcatatattgaaccagccttgcatcccagggatgaagcccacttggtcatggtgcataagctttttgatgtgctgctggattcggtttgccagtattttattgaggatttttgcatcgatgttcatcagggatattggtctaaaattctctttttctgtatattacaaggctacagtaaccaaaacagcatggtactggtaccaaaacagagatatagatcaatggaacagaacaaagccctcataaataatgccacatatctacaactatctgatctttgacaaacctcacaaaaacaagaaatggggaaacgattccctatttaataaatggtgctgggaaaactggctagccatatgtagaaagctgaaactggatcccttccttacaccttatacaaaaattaactcaagatggattaaagacttacatgttagacttaaaaccataaaaaccctagaagaaaacctaggcattaccattcaggacataggcacgggcaaggacttcatgacgaaaacaacaaaagcaatggcaacaaaagccaaaattgacaaatgggatctaattaaactaaagagcttctgcacagcaaaagaaactaccatcagagtgaacaggcaacctacagaatgggagaagattttcgcaacctactcctctgacaaagggctaatatccagaatctacaatgaactcaaacaaatgtacaagaaaaaagcaaacaaccccatcaacaagtgggtgaaggatatgaacagacacttctcaaaagaagacatttatgcagccaaaagacacataaaaaaatgctcatcatcactggccatcagagaaatgcaaatcaaaacaacgagataccatctcacaccagttagaatggcgatcattaaaaagtcaggaaacaacaggtgctggagaggatgtggagaaataggaacacttttacactgttggtgggactgtaaactagttcaaccattgtggaagtcactgtggcgattcctcagggatctagaactagaaataccatttgacccagccatcccgttactgggtatatacccaaaggattataaatcatgctgctataaagacacatgcacacgtatgtttattgcggcactattctcaatagcaaagacttggaaccaacccaaatgtctcacaatgatacaatggatttagaaaatgtggcacatatacaccttggaatactatgcagccataaaaaaggatgagttcatgtcctttgtagggacatggatgaagctggaaaccatcattctcagcaaactatcgcaaggacaaaaaaccaaacaccgcatgttctcactcataggtgggaattgaacaatgagaacacatggacacaggaaggggaacatcacacaccagggaatgttgtggggtggggggaggggggagggatagcattaggagatatacctaatgttaaatgacgagttaatgggtgtagcacaccaacatggcacatgtatacatatgcaactaacctgcacgttgtgcacatgtaccctaaaacttaaagtattaaaaaaaaagactgtgaattggctaagtgttatcttttgaaataaaatactcctaggtcaacacatgctgttacatcctggcagcatgcagctttattttctaaaagtgtaagctttgcttctgtaggtaagctcatgtcactaaaataagtaacataattttaaatccaattcagaatctgagggcccagagaaataactgatcaattaacacactaaggaagtgagcagctcttttctttcctatagtaataaatgccaatgtgaatgtaaagaagcatcctgatctacatctacttttatatataacaagagtatggttgtcagaaagttgtacatacagtatgcatttccttagtgccatagcttttatatctgaggatctcaaacgatcttaaaatgcagaaaaaataatgctctaaaagattcaaattaactagcaaaactctcagtgcaccacacggtggagtcagacacccacaaatctgcgtgaccagtatatgacagaaaatctgagcaggtatttcaaagaggacttaatatggtaacttcatacattttttcctgcttctccgtgatgaattaagctaaatataccatttatgagaaaagaaattatagtgcactaatattttaattagcaataacctttttatctttaagtgcaaatttatagaaacacatttttgttaatacaatgcattgaagttagtccctattctattcctttcttttctttctttcatctatctatctatctatctatctatctatctatctatctatctatccatccatcaatccatacatccatccatctatccaccccatctctatatttaaaatgtcattttggtggcattcttagtggatccttcatcttacacactgtgcttatgttatttcactatctaacttttgactctctattttatttcatgggaatttcgagctgcttttcaggaaatataatccttgaagcaaatctgagtacctgagaactctgttctagaaaacaattcacttactgccatattaaaataaaaccctggagcagaagaatgttttaagagctttcagatggcttgtattctccaatattatgtattaccattggggagactcaatgtcaagaactatgttgataatgcaggtgtgacctgaaatgcatggaaaatagatttgatctgaatgcccaaaatctctttcttgaagtagatctgaaatttcataatttatctgtgttctgctgtttactagtacttttctactgatgtagttaataacatttttattgtagtatttttttagaaaaaccaagcaaaatattttgctattaaaaacaagtaatgtttataaaatcctgaatccatttctaaataagaaaaaacacacagtgccccttatcacaacctgttcaactaaagatgcttcgccctaaaagctccaattttccttgaaagacaatagtataatagctttgcctatcaaatttgctactcataatttcattccgcaagtctgtcacaaagtaattctttatgcattttgaagtacaaacttgcaatattaatgtctagtattcatactgctcaaatttttccttaattccattcagaacgtcacaagcatttttaatcaaacattccttcaaaactcatgtcattagtttaaatgaaagcagttctactctgtatttcatttatagtcatgtagttcttctcaattcagaaacaattactcattcctatcatgcattttactaaaccctgccgtggtagacacactaaataccctgacttgatcattacactttctatacatgtaagaaaatattacataaatgttgtatccataaatatgtataaatattttatatcaaaaaacctttttcattatgactcaaactgggacggacttaggaatagttaattctagagaacctggcttgtgtaagtttgaaaaatatatatactggagtaggtttgtataaacctatcacacttaccctctaaaatatgtacaatcattatatatcaagacaaattaaaaattgaatcctcaagtatgtttactattatccctcacttctactacaatatttactcttgttgcccagtggaaaactatgatgaggattttatcatcaggattctccccaaaattctctttcttcatccactattgcaattgtatgcactccataaggaaataatattccctggactttttaagcctatcaaaactacctatactctgccacatattatcagggacattcttggtcaaagttagacaatatggtaaattaactcatgctattgtgtatactgttgcccagaacacctattaacggtgattcattaactgtaattgcattgtaaccatgatctacaaatctaatatatcacccccaaattcattttaaagtgaaaaacttcagacatcttcaccaactggcagggagaaggctttgagatttgcagctaaccttctagtgctcctctcatcatagcatggacttggtgattgggttcacaacatgtatataagatttgaaaagcagatctagtaattgcgatcacacaaccctaaagacttttgaataaataatacctatgataacttcacatatgtttaaatgttaattaaaaaatgagaacagcattttaaaaatacttcttacagtgaatgtaaatttagttatggcctaaaatttactcatttaaaagtcaactcagatttattttcaacactattttaattctcattctagaaaaacaggtaaacacgttttatattttcgtttgaatgaagcatgggagtgagtgcatgtagctatattgagcatgatcattaataattgaggtgtaaatttatatcgataattttgtgttactcactgcttgtaactaacacatttttataaaacaatatagaccatgtgactaaacgaggagtttataataaaatgtttgagactgctttccaacaatgccatagaaaatattttctttttttctttttataagatagagtctcgctctgttccaggctggagtacagtggtgcaatctcggctcactgcaacctccgcctcccgtgttcaagtgattctcctgcctcagcctcccgagtagctgggattacaggcgcgtgccaacaaacctggctaatttttgtatttttagtagagacagggtttcaccatgttggccaggctggtcttgaactcctgacattgtgattcgtgggcctcagcatcccaaagggctgggattacaggtgtgagccaccacacccggccaaaaaacattttctttaccatttactatcctatggttttactctagcttttagtatagtttgaagtcagaaacaccagaacgtattgctcctgtctttgaaatgtctttatttcaaattcctccattacatccttaaaaaaataaatcttagactaatgatctagacccccttttcttcctacctacctccaaatagtcaaatcagtgaatcaaaacaaccccatggaaaactagttgaataaatttaaagttagaaacactgcaacattttgttgaagtaataaaaacaaaagaatggaagctgattcccagatgtacttgcctgggcttcctgaggcatttgagctgcgtccaccttgtctgcaatataagctgccaactgcttgtcaatgaatgtgagggactcctggattaagtgtaaggatttttcagtctcctgggcagactggatgctctgttcaagcaacttttgcctccttacagcctaaaaagaaggaataagagtgtatcagttaaatgtttactcttgatagcttttctgtaatcctgctgaacaataaatgaagattctagactcttccacaatcacctttttgtaagacagatttcgcagcttcctggcactcattcagctctgttgatagaaaaaaaatgtgaaggagaaaaataaatagcaaacaaaactataggatcagggatctctgcatgaaaatcaatcacaatatcacgtacattaaggaaataggctggaaaaaaaattagcaaaatcatctcagtcattgcaatctgtctttctcaggtcgaatgttcctcctgatctcattatatagttcaagagatttggtttgcttagaatagggtcatcgtcatcacaatccaattcaagacagataatctgcttccaccagtgagatacatgtacaatctgttcagaatcagctccttgtcaaaaacagaattttagataacagtctggttaaagatttattttgaatactatttcaaccagctttgcatgatcttttttctccctactttctttcacaatttggattacagaaattgtttgtacaattgggtttatgttactgctgaagtagaaaaaataataagtaatcctaatatagctgcaattaatcttgattgtaactataagtatgattaggataattcaataatgttcaagtataaataccatgctgcacagattggaaagtctcccttcaaggatctgttcacttttaacagagtagttgtaaaagtaagaaatagggcaggcaacttattgggaattcattatgtgtcatttaaaatacatttccttaatatacaatgtaaaggcatgattatcaggtacaatataactttctttcccacagagcatgactgaggttttaagatgatcttggtttttatattatatatagaatattagatattacataaatactatactttttaagctttaaaaatattagtgatgtcattattcttcagtgaagccagcctataacacagctttgcccaagtaaaactacagttaaaggcatctagactaaggcaaaagaacaggaagtttagtgatgctgcaggaagagggaaggctttcccagtacttctccctgtaccataaattttgactccattaagattttatcctgggctttcctttcttctcattctacccataccttaacttcaattcctcctcacattctgacaactctcaactctacatctctcaagtccagatctccccttgatctccatacttgcatgttatctcaccctattggacatctcctcatgaatattctgcaaccaccaaaagctaacactcccacacatgaactccttgcatatactcttctcacctacttctcaactccccaacttgcttttcctccttctctgtattttttccggtttcagcgaaaaacaaataatgattccctttattagatgtaattctagatatttctacttcctctatcatgtccttcatcatgttgcatctaatcagtcaatcactaattatttattataccttctaaatagttcttgattccaatcttttctctctctctccattgtctttactctagttaaaatcattactatatcttacctcaaatatgctatcagtttcttcactggcattttactctgccacatcccacctgtaaagcagctgcaatgtgttctctcaataacgaattggggcttcctgtctaaaattctctagtgattctttactgtccttcaaataaaagctctattcttttttttttttttttttttttgagatggaggcggagtctctctctgtcacccagactggagtgcagtggcacaatctctgctcactgcaacctctgcctccctggttcaagtgattctcctgcctcagcctctcaagtagctgggattacaggtacctgccaccatgcctggcgaatttttgtatttttagtagagacagggtttcaccaatttgcccaggctggtctcaaactcctgacctaagatgatccacccacctcggcctccctaagtgctgggattataggcgtgagacattgcgcgcagccaaaagctttatccttaatgtggcttaaaagtcccttcataatataagtcctgctggtgtcttttactccctgctctagctatacagaaattttattttttatttcccaacctacactgtggccctcttgattcttggccttaaacatgttgttcccttttactggcataatctcaattctgacttccttttattggctaatttacatttatcttcttaatgtagtggacatctcttccaagtggctacctctggcaccttctaagttcagggaggtaattcttgcatgttctttgaattttgtatttttttgatttgacaagtaaaaattctatcaagttagagcacgtaacatgatgttttaatatatgaatatgttacgggatggctaaattaagctatttatgcattccctcacatgacattatgttctttcttgcactttgtatgtgccataacatatttaatctcccattaatggtctgcatttactttagactatcaactctaatgagttcaaggattacggctgtcctgttcattgctcaataccagttcctagaatgaagcccaatagctttatttatgactgggtgaaaagtataaggagaaattttaatgagaaaaacagaaaactttaaatagtcaaagacgaaaatggatttacagaagaaattgtaaacaaaggtcaccactgctcagagatgtatcttttggacaataaatctatctgtttttgtattaaaagtgtcagaatgggggtgggacattatttggagaaaattttaatctctttctattaaaattctgtatccaagattggtgaccgaggctttgccctatattccaattcaaacatagcttccttttgttctcagtcaaaatttcaactaaaatttacatcaggtaatttactatttcagataacagtgttcagggctataatcagagcctctattgcagaggagactggctgcagcctacccacagctcttccaaagaaatggatctctagtgataaaatttcagcattgtgacaggtggttggagaaaacttccaatcacagcgtgtaataattgcctagccaggtattaaatttggtccttcctctggctaaaggcaaaaacagtgtactctacaaggcacatctgtagattttaattgtataggatgtaatatagaataacattaaaccacatatctagcctcaaaattctttttagaaacctaactttttctattcatgagattctatgagctgaaaggaacagtgtggcttaagaaatgatggcagagttgacttcgggtgggttggctcttttcctggcctgacagtcaataagagaggctgatttacacagattccttgattatctcagtcattgaaaagacctcatgtcaatgcaagcttgcagaattctttcaactagtcatggcataagctgccttctatttctaaacatctgattaggcgcaccctgatggaatgtcaggcttatgaattttctgactttctgcccgcttgacctgtgctgtctcattgaatgaagtttgtagaaagtcttcaaccataatctgattttttgttgttgttccagaatactgttccgctgttgttttaaaatgttatttcatgtctttagctaatccacttagcagtaagaggaattatatagctagacagaaacagcaaatataaggaaagttagaaagacatcttttaataactggcgatcaatgacaaaaatataaaaatagaaaacaatcctagtaatggttaccaagaaaaacacataatatattttaacccagttttcaatgaaaattaaaactaagtaaaagttaacacaaattaattattttatatctttaaagtactatggaaatataaaataagtttaagaaaaagttttaagagtttaatgagttttgctggcaatgtaaagtcatctctacaatgaattgacagtttctcacatttccattttaaaaataatgtactaacctttgtaccacaatattacaaacacataaatcaaagtgtagcatgtctaagaaactctggaagagaaaactctgcatgtgaaataaaaaaccgaatattgaaaccaaaaaatgtatttaacatatgaatgcatgctttaaaaagccaaattagaaaaaaaatcatttaataatattttacaaaaaacacattcattaaaggagctaggtatcctatactatacttattaaactcaatacaaaaagcaattttactgcatttatgaggtgatgggtaagcttatgcttgcaaatggattaagaatgtgggtgcactgtttacaatcatctcgtaataagacacttttatttttggtgtttaaatactcatcattgtattcatcattgtgatgtagacatgtaaaacatttcaatttccagcagttttaaatattttcttctgagtaaagaaggatttttgccaatgtcaaaataaagccctcatttttatgagtgattttagtagtaaatgaactaacgaaaactaaatcccaaattccaattcaaataaagcaaagcaacgacaaagtcttgaagtttctgcttagggtagtgcattaattggccccaacctgactgtccgtaccttgcagaaagtagagcaatatggaatatgttttattttatagaaagtgtcttgggataggagtcctgcaagagatgtgctaaaaccaaatcctactcaacctgcccttcagaaactacagtggagacccatgagaggacattaatctccatttgacaaccacgcttcacttcacagagtttaccagtcaagttttctttcccagagtctcaacttcagtggaccaagcaacacttgcttcagtggatcaagcaatagttcagtggtccaactatttccttttagtgtttcttttttacctactaacaggttgcaatttgttcaagtgccaagtactaagaatactggtgggtgtatatcatttttgataaactatttcctcctgacctaactcttctatttaacttaagagcaagtgtgaaactgtcactatggatatgaatgcattgaattctatctgttgtcttagaattttgggtatagtcttaaactgaaaataacaagtaataagtctctctcattctaagagatggaaatagcagggcatagcaaagggcttacaaaagagctgggaaaactggccctgcctttgttgctccaccatacccacttatactaaaactctctgaaggttttagaaagaatcggtcttctgaattcatggcccagagggagagtagggatggctccctctgtttattccgtaagggggaaaagaagatggtacttcaacctttttgtcccatgcaagtaagtggagctccaagaccactgatcacagggtctgggagtccagagtagatagggatgacacctaattaccaactctgcttctgaagatgtctgcttcagaaattatatgcctacttgataggtaaaaaatgaatgagaaatgatacagtgaagaaggggggcagcctgtactccccagtgcttggtgtggcaaacgtttctcaataggtcaagtgaacgtggaagaagacagccatgtttgagctatctaccaggaacactctttatggagcaagagtacctcaggatcaagaggcttgaagatgtttttatagagcatattttccttcttaaagatggggaaaacaaaagagcttctgcaagacttcttaaagatcccatacttgtaccccaaataaacccgaactttgtatctctgttacacacacacacacacacacacaaatcataaactcaaagctacaaatagctagttaacaggagacatttgcctattttccttaactcctacttcccaagacattggagaataatataactgaagtgcagttaaaaaaaaaaaaaagaaaaagaggcagtggaggtgtaagatggaatctaaccacacttgccttccagagaaagtcttttagaccatggcttaagcttgagctggaaacaaggaagcatattaaattaaatatgacattgagattttaagctgaacccaattagatttaagtctttattacctcagaggccagaaagcaaagggatctattcatggcgccatctacctggatgatgtaaaagcatttcatgtttctgatctatctggctgaaactacgcatcaaactactaacacagtccacgaattcagcacttactcaaataaagcaaaggcaaaggagaatgatagacatccagatcatctagaatgtggtccagcagaagacagaaaatggtttacgggaggtctgaagagataaagaacttaagaaatatctgtgaaaaatggagcattatagtagtatcacatgattgaaaagctaagatagatatgttgatgcttttgtctcatgcaactgcaagttgcatgttttatatccgtctaccaacatacatgaatataaataatccacgtgaaaactattgctcctgtcaaatgcaacaacttgcctactgattggtaactttgctgaacaaccaatttaaattcctgaagcataattctaaggtctttaaagaagcatgccataaaagtatcaggaattatttaaggaccactaagaatgttctatttgtctcagaaattggttcttacaatttttagttgtttagaaccggcaagatgacagccttaaagaagttgacacttcaggagatcgaaaccatcctggctgacacggtgaaaccctgtttctactaaaaatacaaaaaattagcctggcatggtggcaggcgcctgtagtcccagctacgcaggaggctgaggcaggagaatggtgtgaacccgggaggtagagctggcagtgagctgagatcgtgccattgcactacagtctgggtgacagagtgagactctgtctcaaaaaaaaaaaaaaaaaaaaaaaaaagaagctgacacttgaagcacacattgtattgtacacttgaaaaatctttgagattgattagataggaacactttattttccataatttcatatggtgttaagtaatagatcctttaaaagttatacaaaaatttccagatgtctagatatgcttataccagcttaatgaaatgttttccaaaaagaatagagttaggattttgaaaagggaattaaatggagattaagagaaaagcagagggagaagaggataatttacaacagaagaaataatttaccaatgctcatagctcatcacaagattcactttgttgctttctttgttttcaaattagttcatcctattttttcctaaagaaaggaggtctcacactgtgttccttggacaagaaagactaagtaaattaaaaccatgttgctttaacccactttaaatataactcttgtgaggggctttggtacagtggtttttcctgtggcatatttgttaatgtatttaatagggatataggcggtaaataattacaaagatgtgtacatgtctgcatatatatcctttaaatataaaataaagaaggttacattattcacgaaaggcttctagatttatgttttgttaatgtcactaggtttgaacacacctgggagaaaactcaaaagccgtgagcatggagctcctataattttctttaccaggaaagaatataaatgtgaaaactcttggtgtcatggttaataggaacttcacctgttttaggttttagcaggttactgaagttcttctgtgacctctgaaggaagcatacttgaaagtaacgtttgggaatcattttatcaatggaacttgacatcagatagccatcactttcaagtaaagcattgagcattgatagaatggtcaatgagctatagagtaatatatctaagacatttctggattcttgctgcatccatttatcctcatgggtagacaagtgaaattggtcttctgccctgacaggagcaaactgatgctttatttaagcttcaaaaagaaagtgaatgaagcattattcagtaaacataaaataagtctacaggattcatcatatccaagctttctcaaggtaccttcaggagccaccctaagtcagtgaaatttttccggcccaatggcgaggtactctttgactgcacatgtgttcatattattaaagtctaaactttaggcagtgaataatttattgatacaggaaataattaaaatatttaagtcgctgtctcctgatatggaatagtgagacagaatcagattctagggatgacttggtcagcattgagaccacatgttcaagcaaaatataaagtttatacatgagacaaaagtccaaatctggggataaaatcaagttggaaaagatgagaagtcaaaattagaaaaaatgtagctggtgcttctaagccaagtggtataggttaattagccaaatacagaagtacccaagtgagagagagcatactgaggccaattacagataggttggtggttgtgagcaaactagtccttacaatgtagatgaactagccagttgatagtcctcttaaataaggtcagtgatatccagtcagtacagtagtgtgacaaagatctcagagtgaaagaactttggaactcgttagtccctctacttaggaattcagactctcaggaaagaaactcaacacagcatctctggctttctggacttaatatgatgtatgggaagcaaattcatcacacttccttttatagaccaggtaaggatggccacacaggttgcctatgaataaaatagtttccaatcttcagtcaagcagtgtgaaatacagccttgataactagaaatggtgcttttctgatgtgcattagagatctctgctggattccttctactgtgatgtaggctcataatactctaaggccagtgttcaggttctcttggactacagtgccatggattttgccggcctctgtggtcaactgtaattcatattggttcgaacttgaaattgtatctgagcaactggaaaaatgctcctctctcctgggatgtctgggacgactggtcctttttcatcctacccaattacatgaagattaacaatatttatttatcacaaatactccagatgattgtcatggctctggagaagttgatgtgcaaggcacagtatgcttatggcttcctgtcatcttacttatccacactacattgaaaaagtcctcaggtctagctcagtcagtatctacattattgtgtcctaaggttattacaaggttttctaatattttgtcctccaagttgttaggatagacaagactgcagttttgtagaaaagaactcctaccaggatctttggctctgatatgattcatttggatgggatgtgcaccttgaacagcaggaacatggtgtatggaacagctgcttttccttctgctttcgaaacattctgtatagtgctttaggagtaggttgggagtgcagaaagatgactcgtgtgtttatatgagcatagggaacagataaacactggcagaatgatgcattacaatcgattccttgttacagactagggtcatctgccacaaaatgttcttacaatacattaagcttgctgaaatagaaataaactggttccaaacttcctctcttctctatgtcctcaccccacaatggcatcttctcatcgtctatagatgaaacccatcgtgctggaattatttggcatgggagaagaataaacaggtttccggtgtgacgctttaacttgtaggattgttaaacttgtcatacctcagatatagctgaagattaagatgtggacaatgcctacagccatgcaggactgcttagcatcttccccacaggaagtatctgttccgtcaacattgtggttcgggtgagggagagaggtaatatataatgaggatcctagtgatgccctttccgtgtcatcaaaaatctgctgcagtttcctagaaagcgttcattctacttcagcagggaactatggctgtgaaggaaaaccactttttcctctgcttggtttagttgttgaggaattggaaaggagcttcatttctggaatacagagatcatctatctgtcatgagcagtggttgggcaagaataaattactggtccacagtgggaatgaacctgacacataatgcaccttagcaaagtgcaccttatacatgtgctgataaaggtctatctagactggggttcacaaacctgaataatcatcagaatgaacttttccaaatacagttctcagcctcaattaaaatctactaaattagaaaatcagagggagtcaaaagtgggtatgtgtacaccaaagtccctatattcttctatctgtgtaattttggtgatgagctgaaattgagaaggtctatgaagaccgaagttagaaagaaaagatgtcttaaataacaacaacgaaaaataacaggtaagaaaatgcaatcagttgggcttacagcaaaaaagagcgaacagtagagtgctatgaaattggtattaatgctggtcagaatatacgaaacatagtgaggtagaaacagtaaggaaattctccaattttctttgatactttcaatgaaaaattactaataaatatatgcattttatgatttaaaagacagcatgatgaacttgaaaaatatttttattcctcattccatctagggacactggaatacactgcaaagaaatgttgtttaacattcccttttccatttatcattttttttaaaaaaataaacattttcagaaatttggcctgaatattaaataacagatttgattattcaatctcaagaatctatgaagtagcttgcaaagaaaacggttttaaaaagttgagagtggtaaaacgtaagatgaaagagagagatgaatatgtaccctcagaacagtattgtgtgttatagaaattaagtattagttgtcaatcatcatagataattaaagttattgacaagtttcattaacataaagatataaactcgaggaatttttctgaaaaggtacattgataaacttaaaagagaaacttcaatccaaaaatttatcactaaaatgctactttatcaatccatactactgatttagcttttacaactgattagtttttcggccttaatggttttcctttatgtattaactccctcttttgttattccaactttattattctttttttttttttttggtaggcccttgtagaaaagctattccaacttcagaagaaataactcaactatcaaattatgagatatttgaagacaagataccattaaatggatatgttaacactcattcacaaagatattaatgccctccaagagcaaacataatttgtctagagtgaatattaaatacttaaatattaatcatatattgaaatgcagtacatgattatatgtatacatatgtgcttatatacatgtatatataaatacatgcaagtatatatatgtgtttgtgtgtccctttgtgtctggaccccaaaaatgctaatattctataataggcatacagacgaacaaaaacatttaactactgttttatataatatttcggaaaagtaaatatgactgtccaaggaaacattattgattgaagtagggtaaattatatctaaaaataatggaattactacttacaaagaaaaaatccatgattcatggtgattaaaataagaattaaacacattcaccacagacccttttgtgaaggctatgtactctttcagttcctgtagctataaaatagagggtaactacatttaaaatacaagatgtattttaaaatattattaaaaacaagaatcaaggtaactcacacaattgatggtaggacaagaaaaatccctttctcaaataacaaaagaagatacatgaaatagagaaggaaaaatttctaatttacaaagaaaatagcatacacattcatgtctatttttcttacattaaagaggtctgggctattgagtttattatctatgtgtaaatattacacaagtgggtttcttcccctcaaaatgtaatcactcttgaccatttattcaattaatattattatgagaacaagttgcatagtccaccactcagctgaaaattgcagtcaccttgaacacagaggtctgccataatagtctgcttgcagtgcaatttttatataaagacaaaggttttttgcagagcattcaacctaggagaagtcaagattcaagatatccaatatcctttttactacttaaggaaagaaagccctgaattcaaagtatggaaagatgtaaacctagaagctatatccattattaacacactaagaataagattaaatttcacctttctaaatattaaagcatttattgttaattaattatcctcaatgaaatattttcaagtaatgataatctataaaagtgagcctaaattgttaactcccaaaccttatcaaaagcatttcaggtgtacaaataaccaaatgtataagatgacacccgaaattggcttcaaagccatgcaacctgtgcagttatgcagtaactcatgcttaggagagcccatgcttggtttaatgctctgctgttgccatcttacaatgcttaatttttgagtatgggacccagtattttctttcttccctgagtcccccaaattatggagccgatcctgacattttgggaaaaacagccaacagctaaaagactgacataaaaatctgaattaaattggttaagttagagagattgtaaaaaaaaaaaaaaaaatacatgaaattcacatttgacatactggcggtaaccagatgaatgacttgcaaatatgaatatagttggaagaagatacttcagactagaatcctagttgtttcagaatataatcaaatacaacctggagatgctaatcaaagataacgcaaagaaaaatcccttcgcttttgattttctatgcggctgtatgtgtgtggttctaaataaaattattttgcagaaaattacgggagaaagtcagataactgattatttccattgcgaataacttcattggctactactgagtccacgatattattctctaacacttctcctgattttaaacgaatctttaaaacaaaagagctcctattccaaatacttttcactctcatttcctcaatgacaccagttctcctttctcccaaccccctttaccgtgcagagtcctaaacaacctgaaaacagagttacctacttctcagggataaatttatccttggtggataaactttctcaaacttactactctccacctcagaacctccttgtattatctcaattttctctttcccacttccaaagtcaatccttccattttttttgctcgtgtatcctatcttgtaagactttgctcttatatattatgtctttctattggatcttcccttatactacaaacatgcttaaatttttattatcctgaaaatcaacaacacatcttttctgccctattactattcaatttcagttactggcctttctttctcattttttcatcatcacagatttattgtctctatttgccctgctcattttctcttttaccaaatcttaatctcacagttgttcctcctcactttggaacacagagactatatttaatgagagaaggagcaaagaaatacagctagtggaggcatcatgttagctgacttcaaactatactacagtgctacagtaaccaaaacaacacagtactggtacaaaaacagtcacatagaccaatgaaacagaatggaaagcccagaaataatgccacacacctatacccttctgatcttcgacaaagccgacaaaagcaagcaatgaggaaaggactccctattccataaatggtgctgggataactggctaaccgtatacagaagaataaaaccttacaccatatacaaaaatcaactcaagatgaatgaaagacttaaaatgtcaaagcaaaactttaaaaaccctggaggataacctaggcaataccatcctggacataggaatgggaaaagatgtaatgatgatgtcaaaagcaattgcaacaaaagcaaacactgacaaatgagacctaattaaattacacaacttcctcacagagttcctctgttgaactctgtcaacagagtaaacagacaaactacagaacgggagaaatattttgcaaactgtgaatctgataaaggtttaacatccagaatctctaagtaacttaaacaaatttattttaaaaactctactccattaaaaatgggcaaaggacatgaacacacatttttcacaagacgacacacatgtggccaacaatatgaaaaaaaatgctcaatatcaccaaccattagagaagtgcacattaaaaccacgataagatgccatctcgcaccagtcaaaatggctattattaaaatgtcaaaaaataacagatgctgttgggatggcagagaaaacagaacatttatacactgctggtgggggtgtaaattagttgagcccttgtggaaagcagtttggcagagctaaaaacagaacacagcaaccccattaccgggtgtatagccaaaggaatacaaattgttctaccacaaagacacatgcacacatatgttcattgcaacactattcacaatagcaaagatacagaatcaacctaaatgccctccatggtagactagataaagaaaatgtggtgcatatacaccatggaacactacgcagccacaaaaagaaggagttcgtgtcctttgcaggaacatggagggagctggagaccattctacttagcaaactaatgcaggaacagacaactaaatatcacatgttctcacttataagtgggagctaaataatgagaatacatggacacaatgagggaacagacactgggtcctacttgaggatagagaatgggaggaaggggaggatcagaaaaaatacctatcaggtagtatgcttattacctgggtgatgaaataatctgtacaccaaccccccatgacacactgtttacctgtataacaaacctgcatatatacccagaacataaaagtaaaacaacagctagatctgttgagaccatctttcagatctgctaagagaaaggctggtaaagaaagacaagaatcaaagttcattttaaaagttttggtatgagaaatttcaggaatgagatggcattaacagaggtggagaaaacggtgttgggtagctttgataggagctgtcatctgagtatgttaagtttgagtagcctatgagatatccaaagagaaaaatacacaatagaaggctggatatatggtctgaagttaagggcaaaagtctgtgccagagataatattttgggaataattagcatgtaaattttatttaaagccatgacactgcataaagtattataaagagtgaatatagaaaggaaagggagaacattaagcttaaacactgtttcatacacacttggatccagttggccaataatttgtttcagaacttttccttattaatttatgactgaaattggcatggggttttccttcctgtttcatttttgtctgattttggtaaaaaaaaaaaaaaattttctaaccttatattttccagacatgtatattgccttgtatgttctactgagtttgttgatgactggaattatctattcctagaaagtgtgttcaaatttgaatgtaaaataatttcagtctaatatagtctttgtaggaagacttttaatttgtgattaaatttctgtctcctcaggctttctatatccccttccatcatttttgtagcaatattctcctagaaattcatccatttcatgtaagtttctaaacttatttgcatagcttttagtattttctgtattttaaaaatatattataactgtagttataacattttcatccttaagattttatatttgtttttacttccctctcagttgatttgtctaattaaaacatgaatatgggcatttaaattttattgattccatgttgtttttatttatttctgctcttgaattcttctctttccatttactttctctgcatttattatacttttccctattttcttgagatgggcagttagctcactagttttcagcccttccgtctcttctacaaaaattaacaggaaccaattagttttaatttttatttttattatcactcggttctatgaattttaaccatccattttgaattcatctttgatccacaaattatttactttagtcaagtttttactattgattctagcttgttacaaatttaagagtatttccctaataataccaaatatgtgaaatgtattgacatttccatgtacttcagatgaaatttacactctgatttggggttctctatacagtctttatatccaccttatcaactgttaatcatcactatcttcactaacttttgtctggtgtcttgaaagaaagaggcattatgaaatctcccaccatgctgatatagttgtgtatttcttcttgttattctgtggatttttgctttacgtgttttaaaggtattttcccaggtatgtacgagatttttttgtttcttttgacagagtctcactccgtaacccaggctggagtggagactgcaatctcagctcactgcaacctctgcctcccagattcaagcaattctcccacctcagcctcccaagcagctgggactacaggcgtgcaccaccacagctggttaatttttgtatttttagcagagacggggtttcaccatgctgcccagattggtctcgaactcctgacctcaggtgagccacccacctcggcctctcaaagtgctgggattagaggcgtgagccaccatgcccggccaggtatgtacaagttttagaactgttatattttactccattttttgcctaataatgataatgaccataatgtctattttgctggaaataaattaggtgtctaagctttttattgattaatccttttcggaaaatctgtttccattttcgatatatgtgtctttatgtatttcttaaaaacaatgtattttgaattttgatgctttattctgaaaatttctacatttatatattaaatgtattgagcaaatagttctaggactacagatgtattttttttttctttttcttttctttccttttttttttttttttttgaggcagagttttgctctttcacccagtctggagtgaaatggcatgatctcagctcactgcaacttccgttccctgggttcaagtgattctcctgtctcagcctcccgagtagttgggattataggcacccaccaccaagcctggatacttttttttgggttttttttttttttttttttttttgtatttgtggtagagaccaggtatcaccttgttggcagcctggtctgcctgccttggcctcccaaagtgctgggattaaggcatgagctaccacgcccggccgctggtatttttctaccatctatttttttctatttctatttttctaccatcttttcttttattttatgctcatctcacatttttctgttttgttttccttctttcttgctttactgcgtactgattgagaactgttccttttatcattctttgattgtttcccaggtggatgctccattagtggttatccttgacaatttattacagcataaagtcgacatttaatcactatctctaccctctttctaaataaaagggcttgtggctgtaactcccctccatattgtttttaatctagtattttagatcaacattattttaaatgaaattagatattcttatatattttttgcaacaaatgccttttgtatttaaaagcttaactattttttcatcatacttattgcatctaaaacctttaaaacttatttttctactacttctaattcttcatacttattttagacatttttatagtaagggtctattggggtaaaatttcacttttttttcactctgataatgtctaatttcctcttactctgaagaactaattttgttgagttcagaattctaggttgacggtaattttttcaatatcttgaaaatattttccattgcttttttattcttattcattgttgtagataagaagtctaatgacagcctaaatttaattgctttgtaggttatccatctcacctctagctgctaatataaatttgtctttggatttctgcactttcactgtgatatgtctgagattggatttctatttatttactttgcctgttatataatgtgctttctgtttaagtggtttatgtcactggctcttggaaactttcctttaatatccttcatatattactccatctccatttctcaaaaaaattatgacatacaagaaagctgtatataattaacatacacaagttgctgagtttggagataaatatacactgataaaaacattacctcaatctatgacataaacctattcatcatctccaaaactttcctcctattctaatattattattattctgtaacagaacacttaacataaggtctatcctcttagcaaagtttaagtaaatagactaactataggcaatatgctttacagtagatctctaggaattatctatattgtataacctaaacattgtacccttttacaaatatctctccatttttcccttcccctagcccctggcaggaagcattccacattctccttccattagtttgactgtattagattcataatatgattgggatcatgtattatttgtctttctatgtctggcttacttcatgtagcataatgtcctccaggtttatccatgttgttacagcgaaatggtaggatttgcttattttttaagggctgaataatatttcattgtatgtatatatcacattttctttttcctttcacctgtcaatggacatttaggttgtctctatatctttgctattgtaaataatgctgcaataaacaatagagtgcagataatctccttgtgattctcattcaatttcctttggatatatccctagaagtggaattgctggatcatatagtaattctatttttaattttttttttgaggaatctccatactgttttccatagtgtcagcatgaattaacattcctgccatcagggtacaaggggcccttttctccacattcttgccaaacttgtcatctcttgattttctttttaagtaactgccattctaacagatgtgaagacatatatcattgtggttttgatttacatagccctgatgattaatgagtttgagcaccttttcatatatatgttggccatatgtaggtcttcattgaagaaatgccttttgagctcaactgctcatttttaaattgggttatataatttttttatattgaataataataatctccattttctttattctcctctttgaaaactcccattgagataagttatatgttcatattctactccccacccctgtatctattacctattgttcacatcttccacctccttagtttttggtaacacagtctgtacattctcttttagttttcttttaaatcatttctttcaactaatatgtttatatatgatatattcattttctaatttttaattgtagttgtttaattttgatttctttattccatttttacaatgttttcttttttataacttcaataacatttatttctataatattttacctatttattttatactatacatcttgcaattctaatatccggaattctagaagtaaactcaccgttcgttgtataggctgactgtgcttcatgagggcttttcttgtgcgtgtgagtgagtgtgtgtatgtctatgtgtttatgatgagctcaagttcccctgagtttaatctgtgaggacactgagggcacttttcatggtaaacaatttgcatttgcttctaactaatgctaggacgctcctaacctggtgctaccctgacttaatcacttgtttggatatttctttaccctttgtgataatatacactcaagagttcctcaccttacaagaataggccaacacacattttcaggtgacattattataattattctattactttgcactcacagtgagaagacagatgtctttttatgtttgttctctctgcagatagaattctctctgcccattatcttactgatagaaccccagttttatgtggaatctgtgtttagctccaccattttcgtgagccagaggatcatatttcttttccatcaaatgacttaattcacctaaaattggggttcccagtcttagcttttatctccaccatacaaatgtcagtggtcataggcatgttacggcatgacttcagtttcatctgatttttttcctagcctttaaaggtttacttatacttctttgaaagcaacataaaatacaactactagacattttccagcatcctagtgctttccagagggcattacagaagacttagctgtcctagcccttgagaacagaagtcagccctatcacaacaactgtgaagtaagctaatcaaatctatttcataaagcaaatgtgggatttaagtttgatgttgcttctaacggcttagcaaaaggactgacgtaaaactgtgctcaaaaagtaatggcttttactattattatagacagatattgtctacaaaacatattgacaaattaataaagcataatatgccacttattttcctagattactttatagtcttccttcaagcaatgttcttccgttctggtctatctatgctaaggtagatgtgacactgagggaaaaattcaaagtcataattaccaggaaaaattaatacggccctctctgagtctatcataaatgttactattacagaagaattaaccaatttagattttgtccctttcagtaaatttgctatttcatgtcaggcataacaacttacagacatctttgaaagggactgaaatacgggcattaataagccacgaaagaggtgaaataatcactcatcaagagaagtggtaaaggctttggacttctcaatgtgtgactttaatatttaagactctaaattttattttaattagtcagccataatacttttaaggccatgttttaagctttccttaaaaacggggaaactcgttaattgccatattcacttattagcagagtttttatttttaatatatgaaaagggtcacagagattggaggtagtgtagccaaatggtcacgtgcctaggcttcaagtgtaaagagatgggtctaaatgctcaatagctttttcctagggcctttaatatcctttcaatttctgtagaatgggaatatgaaaaaccatatatcggccggatgcggtggctcacgcctgtaattcaagcactttgggaggccgaggcgggcggataacctgaggtcaggtgtttgaggccagcctggccaacatggtgaagctccatctctactaaaaatacaaaaattagcctggcgtagtggcatgtgccagtaatcccagctactcgggaggctgaggcaagataatcgcttgaacccgggaggaggaggttgcagtgagctgagattgcacccttgtactctagcctgggcaacagggaaagactccatctcaaaaaaagaaaaaacaaaaacaaaaaccaccatgtatcataaggctattgtgagaactaaatgagaaaatgcatatctgacaattaaaagggtacctgagcctctgtaaccaaatactattaccaatattattattcattttgttgtattactaaatcatcttctgctgcttggttaccctgttagagaataaagctattacaatagttgtaaaaatgatatgatttggtacgtctgttggagatgttgcctggtttgctaaccatctttcaaatcattactgtgagtagaaaatatagtgctatatgattatcaagaatgaaagatgccttttgaagtgatggaaataatttattacttatttgaatgcaaactcacactctgaaattagggatgggatctagcaaatctcttttaaatattcataggcaataaaagtctggctgtttgactgatttaacaggcaattgaatgttaccttagttctgcataattgcagctataagaaacattaggtaggtgatataaaaacctcacaaacctctgacataggcacttaattgattttaaaaaataggttaaggctcatcttcaaattaaaaggcactttgtttattaatagcaaatctggctgaggcaggagaattgcttgaacccaggaggcagaggttgcagtgagccaagatcgtgccattgcactccagcctgggcttcagggagagactctgtctcaaaaaaataaaataaaataaaaatagaaaataaccacaaaataaaaacttttttgtttaaccaaccaaaaatcaagagaatcatggcctaaaacaaattcagaattcttgattataacacattaatgtacaacaagaattttttaaattgatttaaaaactcagttactgtaatcattttgtttcttcagcctctcagataatttatcccaaggcttattctactgcatcgaaacaacagtctttttaactagatagtggaaatatccaaaggattgatttagctaataaattattaggtgtgtcttttttacctaagtagtttgaaattgatcaaagtgctgagcaaagcctgagaaatacaaaagtcctattactacacattgttttaatttaacattgtatctttcaggtctaatcagcttatcacaggctgatacaacagaatttgagaaggatattatgtttaacatgatgtggttttcatgaaagccgtaaaaactaaatatgctttattttcattgtcaaataactcccaggttattactggccaaatatgtaatataaacacagctaggactgataatagtttcaagtttacttattttagatttattgttattttaacactctgcttaatcattgaggtacaagtggagagcttctgattttaagacttagagggtgataaaaatcctttttatctgtcttcacattttatttaactaatggaggcatgtgcatttcattatatttcatattgcactatctgcatttatttaccaatcactgccctcagtgggatatatatatatgtatatttacatatttttaaatatatatttacatattttaatatatacttacatatatatatatatatatatatttacacccatacaaacacacacacacaatttttgagggctgatactctagaatatcatctagtcaaaataaaaaggctgatcatgtattaaatttattgaataatttattgaatatgtactgtgttcctggaaccatagtactttaagtgccgtattttatattttgctcacaaaaaaaaccccctatgaaacaggatgaggaaacgtaagtttaaaactgttactcaaaatcacatagccagtgaattacagagggatttgccagttatcaattttttgcctttcaacatgatcctgtttttgacacgggaacatttctccccttgccagctgacatgatattaagttctgtcagtaaaggatgctggagtgacaatgggggaggtagaggtttgtctgtcccagtgtgcttttaattctttttcaaacctgtgactctgggctggcctatggaatgcccagtaaggctcacctcatccaccccactttacccagaagactttcagcaacactatgggtcgtgtttgacaagttctatgggtacccaataagcaaattgaggatgggtggcaaatccataggcagcttcctggagccccacctcatttcctcaagtttagtagcatccactacaggtagtttcccaccatgtccaatgaatacaccagacagctttctagcaaattcaatggttccccaccataggctacttccctgtgaattttgtcagcattcccctccaatattctcttcacactagcttcagctcactggctatagacttgttctggattgggtcaatgaaggaaacttctctgtcatcccatgggaggcagacacacactttctaaagaagtttgaatccagccttgggttgagctcctatctttccatattagttccttgtttgtgtactattcctcaggcttaaggtattctttagagatctcttttatttcctattaaaaattaatttccagtaagtagttaatacttatttgtgttaaaccatctctgtttaagtgactgagtggtttctgtgccctgtctggaccctgactactaatacaaggtgttattctagcccaagtttcaagtattttcttattcaaaagtttatgctttaaaaactcagtccagaaaataagataatacgtgttgaatcagggtatgttgctgaaatgaattattttttctttgggggaaatgtcagggtttataccaaaaacctttaaaatagaaggttataagtagttttgtgttaataaaggattgcaatataattacattaatagagttaataccaagatcaagttagagagtaagctattcctaaggacagaatagatgagtactgaaaaatgtcaaacactgaagttggatcttggccaggtgtatctcccagcactttgggaggccaaggcaagtggatagcttgagcccgggagttcaagaccagcctggacaacatggcaaaacaacatttccacacacacacacacaaataaccgggagtggcagcatgcacctgtagtcccagctactcaggaggctgaggtgggaagatcacctgagcccagggaggtcgaggctacagtgagccacgatcatgccactgcactccagtctcagggacagagcaagaccctgtctttaaaaaaaaaaaaatttgagtcttttcacagctaagccaaggtcagtttcacaatgacttttaattttttgatgcaactgctgtctcctacctgacactgatattcaaatagaaataaaaacacattccaattccatatcacaacccacattgaaatgatcttcaatttacttgccacatagcaatatctatttgactcagatccagcaatagtgcaacaatgatgaaggaccagagattgtttggaattccccttttccaatccccaattccttatgttgatttggataaaatatggatatgccacccaggattcaagactggaggtgctgctggtacatttgcagatatctgccctaccctcacatacttctcttcagaattggatagagaagaggttttcctactcaaggcgttccttttcaatctgtaagcatgtcaaaaggtccccgacattgactattcaataagtcattagtcaatggtttcatgcatactaccctagttactacccccccttattctcttttttctcttcatacgttatattatttgtttttatgtcttgcacattctaggaaatcagtaactcttccttaactaaccaatgtttttaagttatgaaggttagcaaatttttcctactcatcaaaccatagaaccatatctcacatgtagtagatgtactcagtaagtgaatataaaactaaacatcattataaaatgggttttcttcttgacaaataatccattcttaggagatagtatgcaaaacactgactaggagaaatttgctattttgttttagttttgatttgaaaaatcacaccatgtgtgatatatgaaaatttatctataagaaatgtagtgttatttatgaagaataaataatatggggtactaacagaattgcatgtattattagcagattacatgtgacataacaaatgtgtgtggaatggagggagaggaataaaatgagacagcgagagagaaaggatacccacacatactggtctatcttgagtaaggaaaagaactctgtggtcagagtaaccttcttgggatgtctcagttgccttttaagaatcctaacttacaatgtttttgtgaaatcacatgctataatacacatgtaaagaatttacccagtgtctggcattggattgtctctgaaacctgaaagctgagctaatatttaaactattgctcattttatctgagaggcctgtatctgctatacattaatgcaaattagattaaagagatttttcacttatcttcatacctcttcatgtagttccctccaacgagaattaaatgtctcaagttcctcattgattagctcatccatgactccgccatctgttagggtctgtgccaatatgcgaatctgatttgggttatcctctgaatgtcgcatcaaattttcaagtgactgaaacacatttgcaataattactatttctccttttttttctaaatacattggattatcagcaaatgctcagtatcttctgatttacatataattaagtcataatcaatttaaagcaaattttaattgggattaaaaacaccaaggagcatttttgcttcaaaaaataggatgtcattctatatgaatcttcatgggattatgacagtgttgcggactgagaacttaaaacttgattcacaaccacctttttccttgacgtcccctaactctaaaaccagaagaggtaaaacactaaatttctcaacttctctgatagctagtggtgtccacgtgacacaattctgaaaaagagtactctctcaagaagaatccttttgcccttcctacttttttgcacatacatggcctggaggtataacaatcatctttgcactgggaggcaatgactttgagtgtgaggtccttcatgctcaggaagagagagcagagagtgcctactcgcctcataatatggctgaaccatcctcaaccctgagtaacctcccttcactattcttttcgtggtgagaaaagatcattttgtgagcttaaaccgttgtctgattctctgttacgtacatcccaataatacccatctcctatactgctcaaaattgacaaagttgcctggctagataatatgatgaaagtgaatctcagtgtcataggcatgccagaaaacaagggattcaatttcatcttactggacctcaaacatatctataaaataagtgatgggcatatgttctcacaaatttattaaatcttctgttttccttgttttaaaaaaatgaaaatcttccaatacatatttgtaatttttcctgtttatgtatttttcttgaattttgagcaaactcaatacattgtcctattaagtttcaagaaaataaagagacttcctaaatacatttatattaaaaaaaatcactataacctgtaaaatactttaaaagccatcaaatttttgagtagaacaatgtgattgttaataattttcctaataatttatattccttattacttctaacaaatcttaattttgtaaatatttatttgcaaaatggatataaataattttaatggatacattattttataagtcttaacaaagtatataccttgttaaatttttttaaaggtggatgaaaagcaacaaagcaaaattaagggatcagttataaatatcttgagttgcaagaaaacctagaagtcgtgcagtttttctatccttgatacgtggtgatctagcccttttcactcaaaatgtcctcctggataagcatcagcaacactaccaaagagccaattttatgtatgtatttatttattttttcactgtggaatttcatttattggctccattatctgaattaggaacaatttgaaattatgaccacaacatagaaataaaagataagagcactcgcaattttcctcctccctgcttgtctgtgttgtgggcattgtgagggcctcgtctaaaatagtaaatagtaatggtaagttttgtttccccatcttttctaaatgctcttcattatggcttcaaattttctctctttccttaacattcctttgtgaacatgccctagtttttcagcacatcactgaaactgtgagagcaagaatttagcatggtgctccatgtacgatttgacaatttcataggctaacagcatcatcctatcttctgttctggccactgtccttttattaatgtgctgtaaatttgctgcaacttttctagaacatgtaacacattgctgattcacaagaaatgtttggtcaattaacttctctgaatacgacaaatttatagtcatagtcagatagagccaaaattaaagtccactggagatctacttcattgtactttaatatcttttcaggttttataatttccttttgaaaattaggaagttggataaaatgatctataggtgtctactctgatgttctaggattacaaattctattctgtctaaagaaataccttacattttcttcacatcttgaataatttatgctccttattttatagatttacagaggggctatactacttatagctttacgtacatatattacatattctaaaacaacatattcattacatatagataagtcaaaagtacactaaaatgcatagagcttgaatgattaaatgtcagaagttaaagtcaagtttataaatgcaaactcatttaattattgaaagtctccaaagtaaaacttaaaaatgtacttacattttatgaatactttaaagatatatttccaatattaaagcatatccatttaataactcaaaacattccgtaaggtgtaaatttgtgattttaagtaagtataaaataggttccaattcaatacgtgcagcttttaaactggaaataatatttcatattatcatcccgattagccctaaagcagtgagtttgtttattcacactgtctttgcaggtttgtggtacatttaattaggtgaagcatctatgtagaacttagtgatataataaaggcaaatttcctctgtgagaagccatttaaaccctttgcaaaatcttgtgacctagaaggttattagggggaacaaaggctttatccaaagtaccagtgctgagtgataacatagtaattatactctcttgggttgttttctttggatttgtcttctatttggtacttgacctcttttaatactgcatataaattatcatcatttggcttaatttacaacttacatctagcacctcagagatttcctcagctccgccaggaatgttttcagtggttttaagtttaaattctacttcatttagccacttgtttgctttctccaagtatgacaataactcatgccaacatgcccaaacttcctaagaaagaaatatatatcacagattaaatattatggtagaaaagtaaatgtgaaattttgccatttcattattaaaacttctgaaaatataacactttgtatttttcacctttactttgtagcaggtaattcaaaatgcagctagacagtttcatcatctaatacctctacaatcaaaagtcattaagaaaacattttattacatgaataatgaataaattcaaaagacagtaatttactttttaaaataaaaataagcaccaacattgcagtctgggaaacagaaaaataaaagcatatgtaaaaatgcatatgtaaatctaactccctcacacatcactgttaccagtattctgtgacctcctctgaaatttatcatatataatttgatagttaaaatttaagtgagtttaactatagctctcttttcactaaacattatatcataccattttctgtattactaagaagacatatttttaatgaaaatctaagacttctttaaagtggctctatcttagtttagcaatttcctttttttagatagactacttttagttttgtttgctattataaatttatggtaaacatcatcgtgaatatggactatttttccacattcttattatttccttgaggtatattatcggaaatattaccactaattcaaaggtttgattattttaaatggccattaatttgtattatgaaactgatttatacacagaagtactcataaaaaagcagaactttaaaatttctacaagaaaatatagaagaaaatatttctgactttggcatagagaagaatatcttaagtaagacatctcgtaaaaaactgaccgtaagaaaaaagagatgaatacattcgactacattaaaattaggaccttctattcatcaaaggacaccatcaagtaattgaaaaacagactcaaaatagaagaaaacaactgcaacatctgtaacacataagaatatgaaaaatgccagcaagtcaaatagaagatgaataacccaatcgataatgaaaagaaaacctgaaccaaaatcttaaagagaaatatgtatatacattaaacatgaagatatgttcaatctcattagtaatcaaggacatgtaggccaggattacaatgagataccatgttgattgacacaaatgagaagtttgacaattccacgtgtgagagaagatatacatgaacaaaaatttgtatttattgttggtgggtgtgtgtactgaaatggccatttcagaaaacaatttgttattctcaataaggtgaacattcacatacccatcaagacaacaactccactttttgatatgtgcatcctcagagaaactgtttaacatggataacaagactgttacaacaatgatcatttcagccctttttgtagtaatcaaaaaaaaggaaataatgtccactgcaaggagaatggaaaaatataccgtcatctttaaacagagaatacagacgtgacaatgaaaaatctcatcaaaaagaaccataagaatgaatctcagacacaaatatgttgggtgaaagacaaagccctaaaaaaactatattatagtttaccattactgtaatactgaaattaagcacaattgttttttcactcatatgtgtgtggattttttttaaacaaaggaataacaaaggtagctttctagatggtgattatgtctattggggaaaagataggaagatgcgagagaggataagaatgtaacaacggtcattttctgttagctttgtaactgttgaatgaacctataagtacagtaaacacaatgcagcaatcatcaccacttactaccacctgcccccgcctcactaccaccaaaattaaaggcttgaaaggaagatttatttcagaaggatctaaaaaattaatcagatttcccaaagttctctatgttcatagcccttagaatgacacagagtattcgatctctatctgatgaaaagtatcagtctcacctgcttggcaaacgtaccaacctttcatacctgcttgatatcttatgtacagtttattgcaaaaagtgaaattaagtgttttgctttaaaaggtgatagaaatctaaaatctgggtcatttccagctcctgctggactacaggctgtcttcattctgggcaaagatcccagtgggaaaatataaatatcttcttaaatacccgagggtaccttagagctttgaagacaaggagacgtgattggtaatgtgtcttattaactttggtgcagattgaggtaatgaactaccttgctgatttaactgtcagaatggatagcttcttctgtcctcaatgcatctgaaggacacagctggagaggctgaatgtaccagctttacaggtcacctttgcaaaataaaatatagtcttgaagcccgaattggagctaaaagccacttagaataactgttaagcttaacagtttggatcttaaaattactttgaaatcacagaatccaaagtggctttgaaggaaagtacaaataaaaaactaaacttctgttcaaaatagtagatggagctgatgaggtaactcccaacatatcctgcttcagttataccaaaatacatgttaaaatacaaaggaaacatttttaattcatagctgatctgtaaaacatgtatatagaacctcaggtgtgagaaagaaaaagagggaaatgaaagtagaaagtggaaaatcaagcttataaaaatactggcgtatcagaacagggtatacgacatcaaagctggggcatttaacactaacttgagatgggaaatgaggcaagccagggaaatgggaaagaatgaagcagtgtgccatccaccctgtaaggaagaagtagaacatccctagccattggaatattatgatttagcaaggaaactattgttgggggattttgggctgaaaaataaagatccacccataacaaacggaaacttaagcttgtatcacacatgagggcagagcataaaatctctacaatcctgatggcaacaatacaaaaactcaatagcccagagaaaaaaaaagacaaaaattccagtaaaggcaattcctattatagatgagctcgcaaataaacaaataaacaaacaaaaaccttactagccacatggggaaattcacttccattagagggagtcattagttgtaacaaatggtagaatccataccttatgacataaagataatagaacaattttggagaactgtacaataaatatgcctagcctcatggtgtatgtttcccatagagtttatttgcttgagactggcaagtggaattcacacctaagaaaaagggcttggttgcctacatttcattttgggagatcatctctttcttgttttcacaagccctggtttaaacagagagagctgacggagacttgaggggagtgaggtgaagagagtttgaatagttaggcaattcttctttctcacccttttatggggataggtagggtaaactcatctgaatcattttatttacaggatctaaaacaaaaccactcatctactgggtggatatattcaggaaggggtggttggtattcatttcctgttgagctgttggtatggccaagaaggaatcaaaaacaactctttcaaacttctcattcctgaaaggtacggagtataggtacttccagtgcccataggctctgagttgagatatggtaggtaaattagactccagggcatcactaaagcattggttaaaaagacataatattcaagagcagtttgtgtaaagctgttgacaagcgtcagcttgaaattcttgttaaacactacgaggtactataaaagcctaggagatcttttttggggggttcaaagctcatatgaataaggccaatctggatcctcaacagagcgaatcaagtctatagagaacgagccaggtcagtggtgataatatatagaagagggacaacagactaggcattatagatgtgtgtgggttttaacaaaagggaacagcagttgtgagcagcaaaaaaaggactttcacatgaagagagtatttttccctcttcaccctcccttatatcgacagtagatctgtatccagaaactgggatggaggaggagactgtgagaccatttattctcactcctgcgtctgtataaattgctgaagcaacagattaatctaaacttgtgaaatatttgattaagttatgatatttaaatttaaattagagtacattttaataactaaaagtgaataaaaagtaatgagatcccagagaaatattgttaaagaagccaactaccaggcagaaggtgaaatttgacagagttgggtgtagttattggaaaaataagacggtgtcatgtttattactcattaagttgaaacatttcagtcaaacagatggtatctgtttaagttgtttaaaggaatacatagaattaatcacaaaaaagaagaaaaccataacaaagaacagatttgtgaaacaactcaataaaatattgagaaatggaaaatatgttttttgaaaaaatataaacacacatacataaatgtagagagataaatatatatacagacaaagatgagactatttctctattgaaggataaattacgccacaggcagctgaagcgagaatttgagagttggaagacagattttagaaaagtatccaaaattgagcagatagagataagaatatagaaaatattaaagggaaaccagtaactggaatataagaaggggatagtcttaatagctctaagaaagttttcccttaggaaggaatgaagagattgggaaaaagaaaatcttcacaaagacaatgcagaaccactaaagaaataacgtatctgttctaattaacacaccaggtgacaaagtataaatgaaagcaaatttacacacagacaaagttgagtgaaactgtagaagacaaaatagggtgaaactgcagagcagacaggacgaagagaaaatttaaaggtaccagagaaaatgataaagaaacaataacttgacagcagatttcctaaaggcaaaaaatttcaaaagacaaataatattttcagtgttgtaggaaaaaaaaaaacctgtccttacataatttcctgctcaactgcatcattatccaatactcagggcaaaataaaggcattttcaatatgtaaaatctgaacacatttgctactcacactcaaggaaagagcaagaaagaaactgaacacagaagcaaagggaagaacaaaaggcaaaactgatcacaaaaactgggaaaatagcatcggtaaatctaaataaatattatatgaaatagttaaaacaacagcagcagcaacagcaattatatggactaatttgggggaaataaggtgaaaatgaaatatgaggcaacaataacgcggaaaacggaagaggtaggttcagagttaaactatgctaatgtttccaccatattattgttagagaggtatagagaaatatttataagataaaataaagtacatattccaaaccagtgaaaaaggactaaaatggaactcaataatttgataacttcaatatgaatagggaatgttagaaatgttattatacatgagaaggaaatggaaaaataatccaataattggtcttgaaaagtttgttattaatacgaaaacttaagaaaatcccttcggaaaatgtactccaatataaatttctaatgaatcacggagtatcatttaaatgaacaacatgaataatagggaacaatgatgcttatttaaggacattaagaacataagaaagtaatagtaggtgttttatttaaacattgtcagaaagcatttcctgggtacaaaaagtccctccctattgtaacatgttagtgaattaattgtggttttcttgagacatgtacagtgccatcagatcccttcccttcccattctttgttatattttatatagcactcacataacactgatacataagatacgtcattatatcctcagaaactgtaatatttcctgacatatagaaggcacttttcaagagtctgaggagtgaattgcatttaaaagaaaagaataaggatgagtaaagaagagcttagaactgataatggagaaactcggatcacattttacaattggaaaatgataatactgtattgggaatatatggggtactttagctacaaatacattttaaaatatttttaaaggtgtactttattattgatctgaatcgtatctttctttaaatatcaaaccctcaacataggaagcaaactaaataatgtttttcaaaagtaaagaggtacctgaacactttattaaccatattcaccaaaataactcagtctgtgtgagggaagggggcttaaagtccaactcatgtgcaatgtctggcagcatcagcatttgtagtggataaagttttgtgccccttggcacagtattttcataagaaaggtcatagcttatttttgatgcaattacatggccatcatttgaggcacctgctttctttatctaaattcagataagcataatctagacagtaaggcccatccataaaagttaaagcagaagttgtgataatacataaatataatgcaaaccatcaaaaaatatagagctggttaggtaacatgtctaacaaagaactctatggggcacggcaattactaaagacaattgtagtaaaaacatacttctctacagaatgcttttccccaaagatacttaaataagtttatgtacatacaaaaataagaaaaaataaagatcattgtctataaatctggagaaaatttataggattttatgacctaataatagtaatgagaattagaagcatagctactcacatatattgagtactaggctaagtagtttaaagagaatagctcatttaattttctcaacaacttatgaattatgtattatgtctagttgacagattgaaaacaggtttacacaagttaagcaaatggcccaaagtcatacaacttataagtgcctgaatgaggaattcaagccaaagttgttttgcactggtatccatgttcttaaccactatgcctcacatatgaccatgtattgacatatcattgacaaagaccaagaaaagcaactgacttccaaagtcttgcatttcccattcagcctagtgcagagccactggtagttggtggttagagtttcaagttccttttttaaggcctcttgtgctacaggtggagcttgagctatgacactatttacagactcagtaaggagtttcactttcgcttctttttgttgggcctcttctttagctctctgaaaaataaagaatgctctcttaatagcatgaaaataactttacatccaaaatgcatttctatgaatcatataatttctttctcacaacatcccagttagaatgagaattacaaaaataaatctaatatgaactccagtctcttccataaatttaagtttagttgaaattggaaagttaaagaaataatttattataagaatacaacagatctgtaacaagaatagactgaaaagtagtctgcatggaggtatggatttgtggtcaaatatatacacattgatataaatacaattgtttggaaaaggcaagaaacaaatatttcaatattaactaggttaaaaaatatttggcagtctagaattgaaatcacttataaattacttggatgaataatattgaaaccatcacaaatatcattatttaagttaaaggatacttaacatagaaaggtccccttgatgctatatttaggaacatattttgataaaagaaagtttcgttcgagaattgaaaacacatgagagaaagagaaaccaaaaaaggagctgctgatatcagaagctggcctgacacccagctatgccttggtcttctcaagtggaaaataaactgtttcacagaatttcaacattggaaaaggccactttgtttccataatggatcaagaccatgacaagatcattccataatcatgtctgaatccagacaaaaacatcaacattacccaaaccacaaaacgcccaacactctcctatcctggttaatatgaacgaacgccgtttctttattaattgcaactttagcctcattctggtcttctctccttctggacaagatacgatacccatatagctatccctacacactaatgacaagcaatccaaagtaaagcttttaaaccctccctcaaatcccctaacacaagcacaaatcctacaatgttttttttttttttcatccacacgcaccccctggcctccatgttgtgtattctccctcattgcaaaaaataatgaacccaacttgttcagctacaagagagttggtggtggtcttcggttgggagacatttacactccttaacttcaaatgcgtacatgtattttagaaacacacacacatacacactgtatctttagtctgtgttcctccaggggtcaaacctgacattagctttcaaatataagtagtttatttatgtgtgccatgtaaaagaaattctggtagctgaatggggaattgagacaagaaagggaagagacatccatatgggcatacttattaatcccagcaaacactgttaatgactagagtttaatcctgttagaaagccctgagaaatatatgcctgcgggttatcccattcaggggtgaagaaattggggtattatttctgtatcatcttccctaattgttaaaggctgttggggaaatgttaatttcccagtacttgcaagcctaccacacaagtgcaaaagtgggattcagtggccacagaaagccctcaagtaaaggaactcaggttctataatgtagaagttgggcctgcatacaatgcggtggttaaggtaagggcttattggcaggatatggataaggtcagctataaaatgcctttgtatgtgtcagcataatcaccctactcctttggatttagtcccacaattccttaaaagtatgcattatgtcagaaaatgcaaattgttttgtctatagaatgcttaacttcaccgattttaattgattgaaatctttagttcaatattctaaataaatcagctttttggcatcactgagcatagagattgtttttacacaaattgcattttgactttagtaattatagtataatcaacaagtttgattaccattcatcatttaatatgtgctactgtgttctgtgccagccatgtcataagtgctacctcattagatctttacccaaaccttctcggatgtgttttgttacctctatattggacattagaaaactgaggttcagagagtttaaggaaatcatcctcagagttatatcctctctttctcatagtttctgttaagcgggtctcaaatgttccatgagctgaagaaggagcatgctgtagtcagtctaatgaataaaattacaatttatgctcattataaataacccaagcaactatataaaaatgtagaatgaagaacacttctttccatggtttttagacttcatatattcttggtttaataagaggctcagatcttgggaaaggttcgaagaacaaacagcaaaatttattaatccaggtacatatgaggaaagaagatgatgatgaatttctctactaggagaaaaggtagaaagctaaatgactggtacagtttctatacaaatcctcataaaaacggtggctcttgtttctttccatgaatctaactatgatatgctctgccatctttcattgctaggatttcacacccgtgcttcttaaagtgagcacccttggaatcactctgcaacttgttctttggtatcaaactcaaacttgttaaaaatgaaaaactacaggcctcacccaagactcactgaatcagaaattctggggtcagggcccagcactctgtgtattaaacaagacttccaggtgattctgatgtccattcagatgcaggaatcactgctgtagtgattatacaaatttatttgtgtatttactattctcactttatgtgtaagttctggtaagcactagtactagagttataatagagtaaaaattaaaaaaaaataaaaccagttaataactttccagagtgtttttcaaagggttttagtataaagttttaccatatagtgattgctgatctccataaaagttttaaagtcagaggttgtttatcaaactgtaccctgggttcttttatgtcaaaaaaactttccttttcaggggaaaaataagttattaaaacagcacttccattttcaggtaaaacacaggaaagaacataaacagaagggggggtctctatttcttctttgagtatcagggagagatgtcaaaataggtctgttagtatcttctgacaataaagaaaaattagctatcaaatgagcacaggtagaagtctggacaaggtactattgctaacctccaggtagtgaagttgccttaaagaaactgtcttgagtagcaggctgaaaactcaagaaatgaaatcttcctgccaactcttccagtggttgttgccagaggcttccagagtttacctctttttactatcacccccatactaaaccaattttgtagctagaccaattatcaaaacatgtcaatcaatgtagacaaatttgttggaacactcatttcaaggatggttttcaaattttaaaaatttgagacagtttactctagagcacaggaaaataagagagatctgactgggttgttggtgacataggcaaatcgctcatagggagagggaagagggccagaagaggcactgaaccaaaggaacccagggataatcagagcagctgaacacaaatgactctatagtatctacttacggatctgaggtagtggccatatataaatagacgcagtgagaaaggaattgagatacaagagaaaaggccatatgagtgacacacaatggaaaagaaaggaaaggaaaaggaaagggaaagtgaaagtgaaagtgaaagtgaaagtgaaagggaaagggaaagggaaagggaaagggaaagggaaagggaaagggaaagggaaagggaagggaaaggaaagggaaagggaaagggaaagggaaagggaaagggaaaggaaaggaaaggaaaggaaaggaaaggaaaggaaaggaaaggaaaggaaaggaaaggaaaggaaaggaaaggaaaggaaaaaagagatgaaatagaataaaataccttcaatcctgtgggctctaccacaaataaagtctgtgactatggctaaatcatttgacctatctgggaattgcagttttctgataagcagagagagaagtgtgaattacacaagtttcaaagtaccttctagctctcacattctgataaagttttcctcaggggtgacctccccaaagtcaaattttaaattattttggtcttttgaaatactccaatggtttttcttgtccatttagaataaaaactgtgatactctaacaaaacccgtttgttaacagatatttgcccacctcctaagacttatctgaggtaattttatcccattttccttccttcaggcagatttctttctcttcccaattagcttcagggtctttgcagaagctatgctctctgaatagaatgtgtttccataaagatttttttaagtggttggcttttccttatgattcagttctctcatattacatacaattcttcataaatgctctataagtcaagtttttctaaaatagcatcctaccaccctcaaatcctgcctgaacattattcattcttgatttcaaaatccatgtttacttctaggcaaattatcatgatttcatttatttttccatttattgcctgctcctcaccacacgctagaacactagaatgtaaattccaaggcagtggtcttgctcaccaccctctatattcagtagccagagggtgtttggcacacagtaagtatgcaataagttttagttgataaatatgctattgctagattagaataattctgtgtttttaatactctagaaatgattatactaattttttcttcattatagttttatacacacataatatttatacatatttatggagtatattagatatttactttcaacatttgactaaagccgtatgacagattcgatatttaaacatctgagttttcatgtgagttactttctgctattaactataatagatatttctgaattaccatttaattatataattttttaccatgtggccctttcacaattaaaataataaataatgagtcatggtcatttatactgtgctaggcattgtgttagaaatttcatatttcatccctctaatgattctgaaagcagacattctgatacccagttcacaaacgaaggaatttggctcagtaagctcatgtaactcaccccaatttatacagttggcatggggccgaactaagttttaaactcaagtatctggctccacattgatttttccttgtcacaatccttgaaccaaaaaaagatctacagtattaatatttcaagtcattctctaagttcttgctagcacataaaaataataattatgattatagctactaattgagcaccaactctgagttaggcaatttactcacatggtagttacaatcaacagttcatacattcaagtgaggaagtatgatgatataaacatgataaaacagaggattatattgactattatattgttgcccaaggccatacgaaatgccactatgtaggttcaagtccaggcttcacctccaaatccatactacatactacataccagtttccttcgtaataagtcaatgttatattttgtcctattgtttcaagaaaagtacatgtaaactcagtcctttctatccatattaaaggctacgggttcaaatatttagtgtttccaaattctcagaaatgccttcaaactaccaaattaacacagtttgttgactacattataaatttgtcttttcaagaatacttttgcacagtttcaacgtacatttacatcagctacagacagttaatgaaatgagttgattctgctctcttaatactacatgatttcaagggaaaattgtttcaaattgtgattttcaattttcataattgaccacaatgcattaaaattaaacagtttaaggttgttaaaatgtatattaaacttgaagctaaattaaaattattaattaaaaatcaacctcttctcttagaaccaggaaagagcagactgtatacaacttcaagcattgttgcatttctttctttttccatttatttcctttgttttacttagtttttctttttttttttttaccttcatctcttcaactgctttctgtaattcatctggagttttatattcaaaatctctctcaagatactcttcttcagcttgtgtcatccattcgtgcatctctgatagatctttctggaggcttacagttttctccaaacctcccttcaaggcctcctttctggcatagaccttccacaaaacaaacaaacaaaacacgattattgacagtgatgaaacattattattatattatttcatcagtatgtaaataacagaaagcttagatagtaatgataaagaagtaaaaagcttatatgcataagaaaataactcatggggatcagatacactcaatttcccataagtgtgaaaataagacatgtctgtttatttggcatacttaataaaatgaacgtattgcccgatgatgataattcagctgtttgtgtgacaatgcttttctgtgaatggagaaaaacaaggctttttaaaataatatgtttcagttggaaaagtaattttattggcatacatagaaatagttattctttgtgttctttcataatgttttactattttaaatattctaagaacttcataatcatgtatctacagaaactctcataaattaaaaagaaaaaacgaaaagtgcataaaacgtagtttggcaattcacaaagaagataatatatggcaatacatgtatataaaagatgttctaataccatttatagttaaatgattgcaaatcgaagtgaattaatgcattttcacatgttaagacagggaaaaataataattaataaagagcccattttgggcagggatgtgggaaaatcaaagtttttatacttgttgagggaaatatccaacataatacaaccttttagatagtaagatggcaaaacatataaaaatgttaatgtccacgaatctgagtcaactgctccattttttgagagtgaatcatgccaaccaaagtgtagagactaacatgtacaatatttaattcagctttaaagaccaaacatcttgaaaacaaacccaaaggtgctttcatgagagattaaattatgacatatatatactatgggatactgtgcatcacaaatacatctttactgaaatgaaaagtggctcaatataaagttttacgtgtaaaatgcaagttgcaaaagagtctgtctgtggttatagaaaacatctgctatttaaagcctcacgcatttttgaaaactaaaactttctacaatggactccattactcattaaccagaaaaatgcaaaacttaaaacatctaaaagaaaatcatacaccttgttacaaggcactctatagtattacaatcattatacatagtgcttttactttaaaaagtaactctattcaaaagatggtattcttctctctggttgaaacaacattatacattttaagtaacagagttttcatagtattaatatataatgcacagttttagtaaaatgaagtgttcatggtactttgcccaatagtaaatatgtgtagaatcactatcgcattgattttccttataatttacaaccattttgagcctaatatagataatacttcattttaggttctttacttacctaggtaaatgtagtacttgatctactacaatgtaaataaatgtttcaccctaacacatctagaacaatatgtcttgcaattgtactagaaaaggtataaatgttattttgtgcagtcaatgaacctataataaacttaagaaaacatgctgctatttttgctattttataaattaagaaatcctgctgctaaatttctacttagaaactctgctctgttataatcttttaaggcagttggtgaagctacaaaaatattagagggactaatggaattcagccaagacttctagtaaaaactatacattcacatacatactttgtgtgtgtgtgtgtgtgtgtgtgtgtgtgtgtgtgtgtatgtgtgtgtgtgtgtgcacgtgctcaagtatggtgagatattgttggatcctggaaattttgaaggcaaaaacgacagcatttggtgatagatttgatgttcggctgtaagagaaatataggagacaagaaaatctcgtgggatttggcttgaataagtggaaagatggaggtgccatttgtaataacaggcaaatttctagggtagtagactggggtatacatcaggaattttgttttaacatgttagatttaatatgcctattattaattgatgtggaggtgttgagtgggcaaatgggtatgcaggtctaggatcattagaaagggtccagattgttaaaaaaaaaaaaaaaaaaaacttacagcaggaacaacttacagattacatttaaaactatggagcttgataagttgacccggagagtgggtggtaatagggggaaaaaaaaaaggagtccacagactgagccctggaacactttcaaatttagtggtcagggcaatagaaccaccaaggatattgacagtggtcagggaaaactaagagataattaagaaagaatgatgacacagaagccaactgaatttagcgatttagtaatacgaattcactgatgaccctgacaaaatctgctttaatagaatagtgaggataacagtttgattagctctcttaattggcatcaagagagaagggaaggagtgaaatggagagaaaggaatgtctgtaaagggaaacgggaatggagaggttgctagagagattgttgtccaattgaggattcttttaaatgacaggagatattacagaataattctctactgatgggaatgatgggaatgatgtagcgtggagaagatgtaggaggtagagggctgttcattagctgttacaatgtccttgtgcagagacaagggaaagggatccaggtacgtaagtggaaaagctggccttagacaaaagcacagaaagttcatctatgtaaacaaagggaaagtagagtctgtgagcttatatgcaggtcagtgggagtactgcaacttctattctgattgcttatattttctcggtaaaacaagaagctagttttttgcagaaagatggaaaaacagactgttagagatctgacgaaagagatctggggatcactacacccaaagagtatactgacccagagaaagacaatgatctgcaagctggcagaaagacatccacgtaacctctaaatcccatttattgataactatttactataaatttaaagccactaataattaaaatatataaccatatattatttacttagaaagtatacatgttttataattctatatatgtaggtttctatttgttttctatctaacaaacatgtacagtgattaatctaggttagatgaggctctatacaccttgaaaagatgaattcatttaattattatatacttatgaattatgtattaatatcatcacattttaaagattgggagactcaagcacaaaaaggttaaacaacttttctagaatcacacaggcagtttatgatgtggatagacttaaacccaggcgatctgatctcagagcttctggtcttacacactgtgcctttccatccacaaaaaaaatattctccagtatttgaccgcgtgtgtctggtttatttcacttagcatactatcctccaagttcatctatgctgctgcaaatggaagaattttcttttttaaagctacataatattccgttatatgcatataccatgttttatttatttgacaatatacatttagattgtttccatgtcttggctattgtaaatattgctgctgtaaacataggggtgcagatacctccttgagatcctgattttatttcctttggatatatatccagaagcgggattggtgaatcaaatgggaattctatttgtaattttttgaggaacctccaaactgttctcccaaatggctgcaccaatttacattccaaccaacaccataaaagaattcccttttctccacattcttgccaacacttagtatcttttgctttgttttgttctgataatagccaccctaacaggtatgaagaggttcttgtggcttttaactgcatttttcagatgattagtgatgcaccttttcatatacctgttggtcatttctacgtattctttagagaaatgactattcaagtcctgtgctcatttttaatcaggttatttttcagttttatttttgctattgaattttagaagttccttatatattttggatattaatcatttgccagacatatgatttgtgaatatttccttccattccctagaatctaaaatagtcaaactcacagaactagagagtagaatagtggtttccaaaggctgagagaggggaaaatggcaaaatgatgcccaaaggatacaaagcttcagttatgcaagatgaattagctctgcagatctactgtacaacattgggcctatagttaaaaatactgtattgttaaaaatattccaagaggatagatcttaggagctcttatcacaaaacaaaaaaaataaataaattaaggggcagaaggaaacttttggaggtgataggtaagtttatcatcttgaatgtggtaataagtctcatgggtatacgcttatccccaaactaatcaagttgtataaattaaatatgtacagcttttggtatgtcagtcatacctcaacaaagtggtttaaacaaaaatagattctcttccatctctaagagtttacgaattatccaatttgaccaagcattttagggatgggagcatggggaaatcttctcaataggcaagaaacagtatcttatatacatgttatctttatttttatgtacctcgtttatatgcccagtttgaaaagtgtacttgacttccagatacatgtctgattgtctttttctccgaaataaatatggctaagatggaaccgctagtcactctagtaagctattccattttgttcttctcttagtacccactctttctttaaaatcacaatgacctacaatgtagctcataacagaaatatatctgaaaacactttgattcttccctcattcttcctctagactatcaacaaacactctccttcagcaagtactgccagatctaatgggatctgttaaaaagaataaaggaatgtgtcatgttaggataggaataatacttctgggtagatgtaagtgtgaaagtcctcatcaaaaatgtaatgaggatactaatcctctgttggatgagtagtttgcaaatattttttcccattctgtggattgtcttttcattctgtttactgtttcctttgctgtgcagaagctagaaactcagatatcataaaaagaaaaataacgattttatgatataaaacatcatatcatatgtggatgtgatgggattcaaaaatgggcaaataatctgaacagttatttccaaaagaagaaaaaaatggccaattaatatatgaaaaaaaaattccacatcggtaatcatcaaataaatgcaaaccaaaaccacaatgaggtatcacctcaccccagctaggatgtatattgccaaaaagacaaaaaataattgttggcacggatgcagataaaaaggaactacactacactgttagtgggaatataaatggtacagtcactgtagagaacagcatggaggttcctcagaaaactacaatatccacaaatatcccctttttcctgcctgttttttttttctacctggacaattgcaatccctacctgcttccacttcagcccttttgatttattcttcttctaataggaatatgcagcaaacttaaaacaaccattttaaatgaaatgaaatgatgccactcctatgcttaaaagtcagatgactttccaaagtacttgacataatgactaaatcatcactgtggcttccatattcctttctgactcattttcccactctttttctcctggcttcctttgagctcctcaaacatgctaagccctctcttgcctcagatgttttctccacttcattttctggcagaattccttgacacaacaaattgtcaagttcctactactcgggtatcagctttaatttcgcctcttcagaaaacactctactgactacccaatagaaagtagttttcctgctcctgtcactctcatttaaagggttcttattgctacattcagagtgtaagcaagacttcaaacaagacattgttgtgataatgtgttaacctatttactttccattttcaccactaaactattatctccgtgaaggtaactacaatgtctattttattccctcacttatatctgatcatttttttagaaatagctagaatctagatttttaaacttatatacataccctttaaaatttaaaataataaccattttatatacccaaaattagatcatgggatgtgaaagcatcttcaaatgtatcagatatttggacaattttgtttcaaattatttatgttttcgcagacattggcatctggtgacaaaaaaggaattatctttaacccaaaagagtgtatcacacacttattttgtctgtagatatttctgtaatgcatagatttacacttcatttccattattctctctggaatgctgaattggtaacaatattcacatatggcttccttgtttttaccgcatcgtcttcttcttctccttgagcgccattgttccttccttttacaacctaactcatttggctacaaagtcagaacatggccagagtgatacttgtaggaaaagcacagatacatataatattctaagattagaaaatggagatcagaacatagcttggatctatagcttttttgctatgcaacagatgagtgtgtttaaaatatatctcttgaacaacaaattcttagtacatataacagacataaggtcttaagcaaagacatttttagagagcctttacaaattgtactcctgtaaaatgtaaaaaccttgaggttttagtaatattgttggttttatactttttttttttggctgatgttttccccttgctctacataaattggtgatgttctttttattcatccattaagaacattcaacaaacaaaaaacaaatacctttcacactggccttccaggaaaacatcaatggtataatctattatttaagtaatattttttttttttcctaaacaactcttctagcactgacttacttcaggagaagaatgtgagctagctgacccagggacagctcatctgtgaattaacagaaccaatgaacacttgtcagtgattgtattagctgagtgatttcccttgacttttctaattttttttttcattttcaaatgtagcttttgccttttgacattacttcttttctattttgaaagtttacttagcagtaaccaaagaccaactgcctctaacacgtaaattgaaaccccttattaatttccaaaaaggtacagtagttcccttgtatctttggaagatatgttcataccaagacctccaatagatgcctgaaaccatagatgatacctaaccctatatacactagattttttcctactcatacatacctataaaatttaatttataaattaggcatagtaagagattaacaactaataaaatagaacaagttatctctcttcttctccctctcaaaatatcttattttactgtgctcaccgattttaggattccaattgaccacaagcatttgaaaccagggaaagcaaaactgcagatgatcggggactaatgtattggtgaacttaaaagtattcattgctttagttcaaaattttatctttcgaacaagaagtatttgatatacactatttttgaatatatcttactatccgtaattgaatatttaaatataagagagatatctataaaatattcttctgtagaaaaatgagaaactcaaatatgagtgtacagtcattttgtgtgtgtttttttttgaaattcagctattcttaatggttactgaatcttaattgttatttaaaactagatgtcagccaggtgtggtaactcacacctataattccagcattttgggaggccaaggaaagagcattgtttgagcccaggaattcaaaaccagcctgggaaacacagcaagaccctgtctctaccaaaaaataacaaaaaattagccaggcatggtggcacacacctgtacttctagctacttgtggggactgagatgggagaattgcttgagcccaggaggttgaggctgcagtgagccgagttcacaccactgcactccagcctgggtgacagagggagaccctgtcccaaaaaataaaataaataaataataaatgtgtcgaagaggccaaacttggaaatgttaatcgaaagttataattatttatcctatttctacatacacatatattagccatgcattttattttgtaccaaatatctccgtgtaacaaatttttcttaatcccattattattatacatttatgttctgaagaaaacatggattggaaataatgactaagaataggatttcattttttagtatgacagttgtgttcaagaaagtcattttaggatcaaaataagatgaatgtgtactatttaaaatatataccatgaaaatatttagatatgctagaaaaaagattaatttgtcagaattaattgtgctttaaagcaaaaacataggaacaaagccttaaccaaaagtaacggtgaagggagacattaggaaatcttagttaagtacgttgaggcaagccacagtgaaagagattgtctatacctgttggcacatgtgatcccactgagtgttaagttctttgagttctgtctcaagtctcgaagcaaactctggctctgcttcattctttatcttctgcccaccttcattgacactgtttagactgggctgaattgtctgaatatcactgactaaaagctaagaaaataaatcaatttaagccagctgaaaaaaattactgccacatattagatatgaaacatagctagaaaatgtaaaattgggactgatggcattgcatatggatttttgtcttttaaaatctgagatacagagatattgatatagatgactgcctaacagtcttgcaaaaatgttcaatggttattatggcatgaatccagtggggaattatttgtattctacttatatcagaaacaaaaggaaataaatttaatatttctggttagaaaaatgtgtgaaaatgatgggcttcatactttattatctttgttagtattttcattttcaaacacaggatactgcagaaattgtttacagtgtaatgggtgtgaaggttatttgtgaggtggatttgcttttttagcttgtattgtaaaaaaatttccttaaagagcaagattgttttcttcctgctgcatgacaatggtataatgaatattatttcaaaatgcatactgtgttatattatagtacagtgcattatagatgaagagaacaacacagtatgaatagtaatttatcataagaaataacaagtagctcaaaggattctttacctttaaattatactgcattttatagtaaaataatgttatcaaatgaggttgagtacaaggcaatgttttgtcagttcctcatttactcaacccagggtttctcaacattggcactagtgacattttagattgtgcagttccttgttctggaggaatgttctatggactgtacgatatttagcagcatctctctcctctacctattagacaccagtagcatctaaccaccacccccaacccagctgtgacaatcaaaaacgtctagaaacattaaaaaaaatccactggggagaggagagcaaaatccaccccagctgtaaaacactgatctaaccaaataatattcatacaaaattattcatattaaaggcatcatataaaaatcttactctgcactgtttcagctgcttttttagaatttctgaatccccaagggcaggccattcctccttcagaaaaacatcaacttcagccatccatttcttcagggtttgtatgtgattctgaaacgagacccgttataaggcattactggtgtgctgattacttttaacacaattcatcattgtgttatgtctaaacacaggcccaaaaacaattcccatgtttaaaggatgtctctaagtagttcttgaggcaaagaatatttttactaagactgcatttttatggtctactgtatgagcactggtgtgtgaagtctgctattgttaaaaatacaaaattactaccaaatgtggttttatgatgttactctcgagaacattaaatcatatccccctctagagaaattttaagttacaaaacaactcatgagaatactaaaaatgtgtccttacagtacataaaacaaactatgaacaataaactcaatgtaatggtgtctttatagcctccctaaacccgaactttcacaaattattttctacagatgacagtttaaatagtccttccagttgggaacttttggactaatattttgtcatcttcaaagacagagcttttgcttttatttgtctgaccagtacgaagtaatgatcaggtaaaaatcatcatcttttatcatttataaatagccagtatctctcacccatgattctttcccgtattacctttttttctgctgttttgccacttctaaaaagtatgattcaactatgctgtctacatgtgttattttcttctgttttacttaaatttacattgaaaatatgtgctccacagaaagtttcccctttaatgtgattattaataataatttttaaactatttatctaagagaacttcaagacgatcaccttgctgttatctttcaagtctacatttgttcttatttcacatcttcactgtccttgttcaggtctttttttttttgtttgttttttgtttttttttttttttttttttgagatggagtcttgctctgtcgcccaggctggagtgaagtggcacaatcttggctcactgcagcctccacctcccaggttcacgccattctcctgcctcagcctcccaagtagctgggattacaggcgtgcactaccatgcccagctaatttttgtgtttttagtagagacagggtttcgccatgttggccagcatggtcttgatctcttgacctcgtgatctacctgcctcagctgcccagagtgctgggattataggcatgagccactacgcctgggctgttcaggtctcattagtgactccattaatgcactggctcgttttgatatctgcctcggtctcacctcattctaattactgatctacagtgatgccagtaatctcctctcctccttcctctcatcttgggaatgttttgaaaacacaagtggaatcatattatttccctctttaaccaatagcagttttttcttattaagtttttattgttattattatcagtcccatcaccactagattaaaactcagattgtaaaacatagcatccaaggacattcactgtctactctcaatccagttttccaaccataatattttattaatccccatatatattgtctacccagtgttgaacttatatcatttaactgaaaatgctgctatgctttctcaagaactctttctttctcggtattagctaactaaattctacctatttaatctatagcagagacaacctatgttccgataatatttcataatcctttttcctagtttatgttggatttccttcctgcctactgtgacaacctttcccatactgtttaatttatttaccatgcaaggctgaataatgctacccccaagatgtcctcaccctaatctctgaaacctgtgagtatattaccagaaaggactttgcagatgtgattacattaaggattctgagatggggagattatactggatcatccaccagggcataatgtaatcacaaaggtcctaattaaaaggaagtcaacacagggaacaggatagggaaaggaaggtgagaaggagaggtagaaagagagggagagggagatagacagggagagagaaattgacactagatgatgttacactgctgactttgaagatggaggatggggacatgagacaaggaatgcttctagaagctaaaaatgccaataaaacagactctgtcgcaaagcctccaaaacagacaaagtcctgctgacaccttaattttagcccactgagactaatcctgaacttttgacttccagaactctaataaatttgtgttgcttgaagttattaaatttccggcaatttgttaggagtgccataggaaatgaatacacctaccttcctccttcactagaatgtgggctccttgataacaagagccatgtaattgtgccctcttaggccactggtcttgacaaataatagatattttcatgcagtatttacataggtatgcatgtacacatatgtttataagtaaagaaatgctatgcattaaaaaatgttttaggtttgcttagtgctttggtttgtaaaaggtaagcacaaaaactaagcagctagactgggatttaaatccaggagcatattgttgcaatgtttttccatcataccataacgttttcgacatttccttcccagcattaacatttgtcacaataattgaccactcaagggacacattacttaccttattgaatattttaggcttttagaccttaatgcaattgttggtttactgtttttctttagcttgagtggttattagtatggtggcactattcaaacaaattaagtcaagggaatttggtttcaggaagaaggtgatgtggtaaaatttaagcatataattacaaattcgatatggtgataaaataagttattactatatattacatatgtaacattaatatacatatacaacaggttacatatgtgatatatattacattagatatgtatatatgtacatgatatataattccattatacacgtatatatatatatatatacacacatatatacatgttatatgtatgtgtgtgtatatatatacatatatatatggaagctaaaaatgccaataacacacattctctttcaaagtctccaaaacagacacagttctgctaacaccttaattttagcccacagagattaattctgaacttctgacctccagaacagtaatgtaataaatttgtgttgtttgaagccattaaatttctgctaatttcttaggagtatcataggacattaatacacctacatttctactgcacatatacatatatggagttatacataatgggatgaatatataatgcaattttatgaacatatcaccatattttatatataatagcacatatagacagcatagttgactcctactttttataagtagcaaaacagcagaaatgaaaggtaatataggaaataatcatatacatactatacattatatatataaaatgattacaatatacctctgtataatgtatatatacataacttttttctagtcataagctaaatgattacccgtatcttaaaagacaaccagactaaatggatgattggttttgaaaattattaaactaaaaacatgtttaattcctattggtaatggtgaaaatagaaaattcattctaaaaacactgagaaaactcctattcttttcctagaaggaataagcaaatcgccatcctttgtaaaagactcatgtcttttcatcttctcactaactttgaaagatgctgaaggtcaaatgcttatgtacctttacagtttacagtgtatcgttagggaaaaaacaagtaaataaaaatgagggtagaaagtaaaatcttgaattacctgaatttttcggagtttattcatttgctcctctagcttttgacaatgctcaaccagctgggaggagagcttcttccagcgtccctcaatttcttcaaattctgattgatatttccggctaatttcagagggcgctttcttcgacatctctttcacagtggtgctgagatagtataggccactttgttgctcttgcagagaactttgtaaagcctaaaaaacaattttttaaatacatttaccctaattgatgaataataattgatgagttttagtgaaattaactgtacttgaaatctatatgattcaaacatgtaaacaaagtagatgatcttctatcagttataaacttctagtggtaatttaaattttacatattatcctaagagtaacttgaatattatttagtggtatttaacactccatatgtatttttctgaacaatgtcaaatatatctcaaaactatatcttacagagccaaaaagttttggtgcatctaattttactgaattaagtatatatattaataactgcatttgtgatacagttaatggagttgaaattaattatactgagctttcaggaaagtaaactctacataaaactatagctaataatattgatatatggaatagaaaaacttattgaacaatctatgtacttaatatattttcaaaaaatgttattctgttatgtagtattatggtgggattcaaggatagttttgtggagaatttataaaatttatttatacttattctgtataacacatgtaatttcttacagtaggatcataactttagacttcccctgttcaatatttactttaatgttacttttactttataaaataataaaggctcatgacaaaaatggaaaaaaaaaccagaactactagtactttatataaattttcaatttgttctatgtatagctaaatattaaatatatgatcatgtatgcacatataaacagttattctttcccctataatgtgacctatatcaacccaaaatttgtcaaatatctaagttttatagtttcatagtatcctatgcctatttggtggtacttaatttgtttttttactttacttttttaagtttatttcactttttcaaattgttcccctatgactgattatttagacaatatctagcatataactacactttgagctaggtgttttagtgtgagcatttgcccatgtcaaataattattttttcaaaaacaaaaattgtaatggcttttctagttcaacaatttccattattagttctacacattcatttctagttttccactcctgtaaattatgtttatctctatctacctacctatctaatccatccatccatccctcaatcaatcaatatcctatctatctccagttccatttacatctttgagtgtattctgattatttccatcagatacagatttcatggaaattatattaatgttgtatgttattaggatgcactgaagagttaacctcagtaaaattcatattgaatttacatttccagcagtaagagacaatttttatttcaccacttgcaaattggtacttatatcttttgtgtgtatgcaatttagtatgcaaaaaaaattctcatcttgtaatttttttacttcttcctttacaatttaagttacaattattcataggtttattattcatatatgtctctttttggaggataccttactcaagactttcttccttactcacagaaaaaaaaagattccttggtatcatatttctttaaaattgtctctggtgtttttacaatgtttgtgattgtttccatcgatttttatgcttctccacctaaatttttataacattattattttaaatattttccaaaatttgggcttccccacattttttgaacattttattgtatgtggtttttattttggtgtaactttgggggaaatgttcatatctttttttttagttagttaatacatttcccaataatatttatgaacaattattttctttcctatctttttcagtggaaatagtctcttctgctcatctaactgccttttcttgtgttttctccactcttattcttgcacatttttattcttatgtttaaaagtttactagttctattaggcaacacatttttccagatagactttggaatcattatgccaagcattaaaaaccacaacaaaaggaaacaaaaaaggtgaaacagctaccatttggtattgtagtagaataaatatctaaataggacaatacataatgaaagttgtttaaatgtatttttctttgaatacattacttcaaaaaaatatttaattatccaaaaaaaattctatgtgataaagtttaaatttgaatttttaaacatttttcttaaaatgcacatattatctcagcttctaaatataactaatacgttttcatgtcttcagaaataaaaagttattgaacatataatgtagtattttataataagtaggaaaagggctgggcgcagtggctcacacctgtaatcccagcactttgggaggctgaggcaggcagatcatctgaggtcaggagtttgagaccagcatggccaagatggtgaaaccccatctttactttaaaaatacaaaaattagccaggcgtgatggcacgcactataatcccagctactcaggaggctaaggcaggagaatcacttgaacccgggaggcgtaggttgcagtgagccgagatagcactgctgcactccagcctgggcaacaagaatgaaactccgtctaaaaataaaataaagtaggaaaagtattataaaatctcttacaaattatttctttcatttcccatattagtatatctttcctgatagaaggatgttaaaaaaatgtagctattagaattcaaatgtctcattacattacagaaaattaatgtttaaatttaaaccaattttataaatatagccagccctccatatttgtggattctgaatgagtggattcagtcaactactaatagataatatttgacaaaaataactacatctgtactaaacatgtaagactttttcattgtcactacttcctaaataatacagtataacacatattttcataatatttacattgtattaggcattataagtaatccagagatgagttaaagtatatgggagcatgttcataagttatatgcaaatattacaccattcatataaaggacttgaacatctgtgaattctgatattcataggagttcctggaaccacttccccatggatacgaagggatgactgtacactgattttacccaccagtttgagaatgtgacaggagttacaaataaagaagcaaaggtggggaataaaacaatggtttttctaataatcaaaatcaatacatctgaaaatgcatgctaaattaaaaatatacttcataaatagatcatacaattgttttcaaaaacagcatgtatatatgcccatacatatatatccatagatagagtatatgcataaataatactgtaaagtctcattttcatttgctcaatgggcaaactaccatacttgtcagaatgacttaaattctaatattatttaaaggttatatcaatgtgaatgcttgataagcgtgctttattgttttgacattcaaatattcacagacctgcaattccccgagtctctgctccatgatttcatagtcggtgacactaagttgaggtatggagagtttggtttctgactgctggacccatgtcctgatggcactcatggtctcctgatagcgcattggtggcaaagtgtcaaaaactttatcaaaagggaaaaaagaatgagaatcacttaattgtttcacactttgccatgttttcctaaattgtcagcaaactcaattatattactagtttcaaatattaacaaaattagaaaatctgaaaaatatatttaatatgattatgaagatacattcctgctacatgtgtaatatgccagggaccttacacatattacattaaattcacaaatcagcctgtaaaatctatattgttcaattcgttttataaggtcaggaaacagaaaaacagataagggcaggaaacagaaaaacagagaagctaagtaaattgcccaaggtgatacagatggtatttgcagaaaccgagcagggtccaattgtatctgatactgaaaggctactctctctcagtgttatcatttgccttggaaaaaaaatagtatcattatccgaagaccttgatttttaaattatatcatgtcatgtctaattttactgaaagaacacccatgtacgcatgcttagtatatgtatcaagaactctagtaataaccccataaatattatcattcttaattcttataataaacctgtgagacatatacattgttaatcccaattgcaattgagaaaacaggctattaaagaggcatatgtgtatgtatatacttttatatgtataattatattagggaaagtattatatagagatatacagtatgtatatacaaacaagtttatacgttttaaagtatgtatgtgtatatgtatatatatgaaatgtgacttaagcagccacatggactatattgaaagagattagacacaagattgagaacgctgcagagaactgtaaaccataaaaaggacataacatattttagggataatccaaaagaaattctagaattaaaaatacagtaagtgaaaaataagaattaagtgcatgggtttaacagcaaatttgacaggggtaaatagaaaattactaaatcttaagattcagaaggaaatacctggaatgaagcatggagacacaaaaagatagagaacacagtaaaacggtctaatatatatgcatcccagaatgtggcagaagccatatttaaacagataatggctaataatgtttctaaatacatgaaatcacactgcaaagtcctggtttatatcaccacatcaaataacattatctaaatcatattattttaattgctgggatatgaatgtcatttcaatataccaattccttctacactaaatgagaagaatataggaaagtattttgcatgtatttaatgtagtattcagatggttgcgataatcttagagagtgtgttggcaatggatgctgaaatgttagaaatggataatttttttcaatatgtttatattgcatttatttgggaactcataaaaatgttaagagattatatttaatctgagcacttctgatttcttattaaaagatatttgtagtacttaaaatctgttttaatttacataaataatatgtttctctattaacctgatgcatttattttttatttttccataagttattgggggtaaaggtggtatttggttacatgagtaagttctttagtggtgatttgtgagattttggtgcacccatcacctaagcagtatacactgtaccctatttgtagtcttttctctctccccccaaccttccccacaagttcccaaagtccattatatcattctaatgcctgtgtgtcctcatagattatctcccacatatcagtgagaacatacaatgtttggttttccattcctgagttacttcacttagaataatagtctccaatctcattcaggtcactgcaaatgctgttaattcattcatttttatgactgagtagtattccatcatatatacatacatacatacacacacacacacacacacacacacactcaccacagtttctttaaccactcattcagtgatgggcatttggattggttccacgattgtgctggtgtgaactgtgctgctataaacatgcatgtgcaagtatcttttttgaataatgactttttttcctctgggtagatacccagtaatgggattgctggatcgagtggtagttctacttttagttaaggaatctccacactcttttccatagtggctgtacttgtttaaatccccatcagcagtgtagaagtgttacctgatcaccacatccacgcaaacatgtactttttaaaatttttttgattatggtcattcttgcaagagtaaggtggtatcacatggtggttttgatttgcatttccctgatcattcataatgttagcattttttcataagtttgttgaccatttgtatatctccttttgagaactgtctattcatgtccttagcccactttttgatgggattgtatttttcttactgatttgagtttgttgtagattctggatattagtcctttgtcagatgtatagattgtgaagattttatcccactccatgggttgcctgtttgctgtgctgattgttccttttgctgtgcaaaagctttttaatttaaattaggtaccagctatttatctttgtttttattacatttgcttttgggttcctggtcatgaaatccttgcctaagccaatgtctagaaagttttttccaatgttatcttctagaatttttatagtttcaggtcttaggtttaagtctttaaaccatctttagttggtttttgtataatgtgagagatgaggagccaatttcagtctcccacatgtggctagccaattatcccagcaccatttgatgaaaagggtgtcctttctttactgtatgtttttgtttgctttgttgaagatcagtttgtgtaagtattttggtttatttctgggttctctattctgttctgttggtctatgtgcctatatttataccagtaccatgctgttttggtgactatggccttatagtatagtttgaaatcaggtagtgtgatgcctccagatttgttctttttgcttagtcttgctttggctgtgcaggctcctttttggttccatattaattttagaattttttttctaattctgtgaagaatgatgctgttattttgatggggattgcactgaatttgtagattgcctttggcagtatggtcattttcacaatactgattgtacccatccacgactatgggatgtgttttcatttgtttgtgtcatctatgatttctttcagcagtgtttggtagttttccttggagaggtctttcgactccttggttaggtatattcctaagttttttgttgttgttgttgttattttattttattttttgcagctattgtaaaaggggttgagttcttaatttgattctctgcttggtcgttgttggtatacagaagagctactgatttttgtacattaatcttgtatctggaaatgttgctgaattattttatcagttctagaaactttctggaggaatccttagggttttgaaggtaaatgatcatatagtcggcaaacactgacagtttgacttcctctttaccgatttggatgccctttatttctttctcttgtctgactgctctggctaggacttctagtactatgctgaagaggagtggcaagagtggcatatgcatttatttgaattctagatgattattaataaacaaaatccaaaagggaccttataaatagcagtgaagtaaagaggtatttagttacaatgaagcaaatgattgtgtctgagatgtcatttcagcaaatgatctagaaggagaggggactatgggcagacacatggcggtatgttggatgaatcataagcttcataaaatttggtttaattgaacttgaacatgtctcctctttaacttctttctggtctttctgtttaatgaaaactgaaacacttcagtctctgaattattgatctttttctgtataacttctgatctgtccaacaactgaatctcacaggaatcacttcatattggtaaactataattaaaacatgcatattttaattcctccttgcattccaaccctcatcctagttttgtattaaattcatttgaaactggtcatttcaaaaaatctaatctcttggaaattcttttgtagctttaagaaataaacttccaaagattggtttgggaacttgtccatctaatatagtttgtgaggcaagctggaaaaaaaaatacacacctactaacataaatatcacaatttctttttctgattttcttatgtggaatgtaatgacactatgtaatgacagcagtaattgctatcaaggttcaggaaatgcttgacaaatttgcaacggtatagagtatctcatttaaaccatgcaggccagggaatgccagtgaagaattctaaatctgtttcagataagaagaaagaaaaagtcttatacagaagctaatgtacccaagggcaaacacagtatgagctgccccacctactagctggtgagatatctgtagatgctgcccttgtgatcccaacataggagcagaaatagaccagctccatctacggaaactcactttttttccttttatgtagaaatagagattaataatccaacagataagtttatctttactgacagcaataagacaataaacatatccaatctaataacctaccatcttaaaagacctcgagagttctactgacatcattagactcagcacagactcaggaaaaatatggcctgaagatttaacgtttagccaatatattgcttataaatatgtaacttttttctctaaagaaagtattcctatgacagtttctactattcggctgctaaaggaccactttaaaaatgcagatatctttttggttttattagtgaaatatattcaacaaaatgaaaatcaatataagtgattgcaagcttggaagcacgtgctgtaaattattgggaaaataaaaattaagggctcctatcctgcactactgtttatcttgaaaagtaaaaaaaaaaattccattaatatctagacatttaatatagccatgtgagggatggaagtgataaagtataggcaaactgacatctaaaattatagtaaaggaatacaaaaaagaagttttctgcaccttttgtttaaaaactgcttgtctttaactcttaaaagagggaggggctaaagggaaaagaagagagaaaaaaggagagcaaaggacagaccaagagaggcaaagcaagattcttttgtgataacaaaagagctaagtatgaaattagatgctacattttctaatacacatgagtctatgtcaagggcaaaccactttaactggaaagcaaagtaaacagagaagtatattgaaaattctgagagacataactatcgagataaagagataccagagcaatcggttatatataacactttactgaaaaaaaaaatctctcctcttgaaaaatagaactactcagaaaataggcacttaagcatcagagaatgtacaatagagagaaggaagacgtaactgtgccaaccaataaggtagcaactggctacccgtccgttaagcacttgaaacgtggccagtttgagttgagatgttttgtatatataaagacacaccagatattggacagttcatacaaaaagaatgtaaagctatttccacattttaaaattttaattctaagatgaaacaatattttcaaatgacttttacctgttgatctgttaatgtggtttctagaacatttaaaattaaatatatggctcacattatttttctgttggatagtgcttagatagaagctggaaaaggcacccatgtaatccatttagggggagaaagagatgatatgttagtagtcttaatattgacagcatttaaaaacattagaagtcctgttgtgaatatgaaatcgagtccaatttgaattccccattattacctgtggggaaaaaaatgcactgcacatgtgtgaagaagctgaactaatgacatatacctacttcggcaaaatgctcaacttgagcctttaattccatgccaaccagatcccacctttttcctcattccccatgatcaatctaaagtcaaggagataatgcaatcagcaaaggctccaaactttattaaataacatagaccatgacaaaagtaagcatttctctaaaatgtgaacactgacaaaggtgtcaagaaatacaacaggacccatgcatgatatatgatgattaacatactaggaatggtccttcagataattacaagtgcaaggaagtctgagtataacttgaatttctaatgtcaatatataagttgtttccttagtttgaaatacaaggatctttgtgattgggaattcaatcaacattttagcccaatttcctatcaaaatcaatattctatcctccagtcaaaatatgccttttaattacttcacgcctttttgcttatgcaacttgctctgctgaaagtcgctgctgctcaggctccattctcacaaagggcacttggtgtggtctgacatgagtgaaatagatgggtttataggaattttatctaagatcaccatagaatttgttttataagtcataaaactccaatgaaccaactgaaattggggtcattttcataaatactgctctattattcacctcctggacaactgatttattttccaggtaagtctcatttttctgaccaactttgtgtaagtataaactaccacactacagaaatatttattagaatttaagagtttttttcttttgctgaattttccctttttctaaaagcagctctatccacttagcaatcctattttcaaaatatcatgttaaactatttcatatttaactaacaaataataattatgtgtatttatggggtatcatgtgatgttttgatctatgtatgcattgtaaaatattcactcaggttaattaacatattaatcacctcaccaacttatctttttttgtgatgcggatattaaaatctattcttttaccaattttgaaacatagatttttattaactgtgtccaccacgcagtactagagatcgctacaatttattcctccagtctaactgaaactttctatcatttgatcaacaccttccctttcccaaccttcctcttccccccagtctctggtaactacctttctattttctgtttctataatttgacttttttttggatttctcatataagtgagatcatacagtatttgtctttctttgcctggctcatttcagctagcctaatgtccgccagttctatctacatggtggcaaatgacagaaattccttccttttaaagactgtatagtattccattgcatatatatatcatatatagacactggaatatatttatcactatatatatatgtcactatatatatcagtatatatatctctatatatcagtatatataaatcactatatatatctaccactatgcatatatcactatatatatcacattttctttatccattcgtcctgtaatagacatttaggttgtttccgtatcttggctgttatgaataatgctcaaatggatatggcatgggcaacaaaagcaaaaatagacaaattagattgcatcaaactaaaaagctcctgcacaggaaaggaaactattaacagagtgaagaggcagctcacagatcaagagaaaatatttgcaaaccaaatatctggtaaggagttaatatccaaaatatatagaaacctcaaaaaactcaacagcaagaaaacaaataacctgatttaaaaatgggcaagggatatgaacagacatttctcgcaataagaggcaccaatggccaacagatatgtgaaaaaatgctcaacatctctaaacatcagaaaaatgtgaaaaccacaatgatgtgtcaccttacacatgttaaaattagaacggctactttcaaaatgatgaaagataaatgttggagaggctgtggagaaaagtacacttacacattgttggtgggaatgtaaattagtacagccattttggaaaatagtatgaggttcctgtcacataaattttataaatgtgtgtgtgtgtgtgtgtgtgtgtgtatatgtctacatgtgtatatacacagtatgtgtctatgtgtgtacatacacagtatgtgtctacgtgtgtacatacacagtatgtgtctacgtgtttatatacacagaatgtgtctacgtgtgtatatacacagtatgtgtctacgtgtgtatatacacaatatttgcctacgtgagtatttacacagtatgtgtctgtgtgtgtacatacacagtatgtgtatatatgtacatacgtatatgcacacacaacttgtgtacatatacgtatatgtacacacagcgtgtgtatatatatatgtatagctttaacttggcatttagcgagttttcccatgattcttgaggtcagggaacaattcttttatctcacaataagcacatagcttgcttaaataaacatgtctgctatgcttgctcttgatggtattgataaaaataacacaatttttaaaaggaacatttacaaacagtttacctagtttctggagtgaaggagcaatgcaacagattatgtgtctactggaacaaaacattcctttgcctagatgtattaaaaataaaattttaaaataaaaaatttaaaattttaataaagtaaattaggtcaatttcctgaactgcagctagaagagttacctcacatcaaactttgttttaattcccagtctcagcatcctaacagggaggggtagagactaaccatagagcttgaaattgtggccatggagagcatccttgctggctacccttaaaattttcttctactgtctctgtaagaggtaaaagttattttctttcaattctggcaagaatatcttctgtgctacacctccccagatcatcacctcttcaagggttgaaatgatttttctttatcttatcacaactgtagtttaaggttcaatggactctcctctgtgtggctattctttccacaagtcttcctgcttctcctcagacttgtattgcatttcttcttcacataccagctagagggtgagttttgaaaaaatacaactaagggtacttaatttcctcaattgaaattctttcggaaatgtctactgctcttaaaatccaaacctgttatagaagttctataagagcaattctaccctcatcttgtcctaatctttcattgatttgttacattccagcctttctggcctcccttatgtcttctggacatgccaagccctcattcttcacctttggcaatttgtgtttcttttcatttctcctaatgtcctttctccaacttatcatatagctggcacctgcacattctccaggtttggttctaacatcatctccccagaatcacggtttcagacgccaaagtaattataatctgcaataatattcagatattcaattttattatctttctttcaataagctccatgaagacatattgctcttgattttctccaccatgtatattacctagtgcccagcacttttacggcatataccaggtgttcaaaaatatttcttgaatttattagtgaaaaagtgagcaagactctgttctgaaagcaatctaatggtgtagaacagaagagaatcattttgaaactttagaacagtcaaaacactggctttgtcataactaataatgtcactttctccatttttgcaaaactaaaccaaaccaataaaatccctaataattattttaacatgatttccaaattgttaatgaaataaactcaaattatatgaccaatctttttccttctttacattaagaaataaggtttcatttttttctttgttgaaacaattatctacaacagactagatgctgtgtttctatattcatctagcatataacatgagtttactggttttcagtctctagaaaagtattttatcaactgtcatgggaaacaattccaccccctcatcctcccagacctaggcaaccactaatcttatttctgcctgtacagatttgcctattgtggccattttatatcaagagactcatataacatatgatcttttgtgactggcttctttcactcagcataatgtcttcaagggtactccatgctgtagcatgtatcagtactttctccctttttattgctcagtaacactgccttgtatggatgtgcccattttcttcatatagtcatcactggatggacatgtgggtttcttctacgttttggctattatgaataatgttgttatggacattcgtgtatacgatctagttcttacagcatcccatatccatgcttttagttattcaaaccccattagcttacttgtgatatagttgtaataacaaatactcaatgtgtttctctctgagggttaggtaaaatgatgtataaattagttatgcatagagtaaaaagtgctttgaaaatagaattttatctttttatattattttcttctatcacttatgtcaggtaacaactaccaattccttatgccattttccaacactgatagtatattttaaaagccaggtttttgtgtgaaaaagcaagtttaaaaaagtaaagaggaaataaaagtcagtatggatgcctaggcacttctgttagctcttatttcctgcatacttaatacgtccaaagtactgtggaggaatacaagaaatgagatttactccctggtgccagttcggatataatgcatacacatgtgcaattatttgaattaatttcaaattaacaaaatcaactgctatgtaatttcatatgctacatttttcattccatatatatatatatatatacaccatatttaattaaagggttatttattaatctagacaagcattccaaaagggtgaatagtaaaattaaagatgtgtagctacagtggaagtggggacaatttgtttacatataatagcagtgaaaaagttaggaagttttataaacaatcatcgtttgtaggtatgaaatttaaaaaagagaagaaagatgatagggatggatggatggatggagagctgtatgaatagagactatatattattacgtatttatattgtaacatcatagacaaatctcagttatcaaacattgctattctgaacatctttaaagtaaatgataaaaagttgaactttaatatgattaagaggtatatacagattaaagtaaatttccagtgaaatggctcctttgcacaacaattgctgcatagccactaaatgtatttaactttaagggggagttatgtatgtaatgacaagtgaaaatacattattgttaaatatgtcaatatttgaaaatctaggacatttaaaatattttcccaaattgattttgcagaggcacagtaacaagtatactgaaatccactagagggagctgatactatttataaagttttactacctgtacaggaaaataaaccccttagcaaaaacgactctgaagtacaaaaaaaaaaaaaaaaaaaaaaagtatttatcctttgctttatttagctcatttcatttttgtaaaaaatgaaaagctgggaaatgagaaaagcgttgtgtatcactacattaattctggaaatgatattatatggtgaattctttaaatatttacaaagaaaagcaataggataatatattttccaactaatttaagttttagtagtaaacaaacacatgttcctgtgcttctcatgacaaatttgggacagagattttttcagaaaaatacttttatcttaatgccttcaaacccgattttactcaataattccttttgtgtgcacatgaacacatatatgcatgtatatagtgaatcaaaaccccatttactatttcttaaaggtggtcattcatctgtctctgaaaagaatttttgtcttaaaactaagttgatgagtagagatattttggagcagatactatgtattaacatcatcttattaaagcaattcaggaagagacaaaagaaacatcttgaaaaatttgctagtcgcatggcatgaatttgcataattgctccacttttatcttttatcatcaaaggaaaaaataggatttatgtaattatagtgatccagtagtaaaatgtagcccaaagaataatttgtcctttgctgagtttcagttgccacatgtatgctaaagctataatactcttcagataaattgacagaaatattagaagatgcctagcaaatatccttgtatatacagcgagccagacttaattgaagtgtattcatatgacctcaactgctcttttattttcttctatattcaaaacatctgattttgaaatctacaatcccccaaggagaagctattcccatacaaaacatgttttgtttctcaaagtcacaaaattattatgaggacaaaaaaatctacagacagcttatctgttacaccagtatttcgttccttgttaatacaggttgtagggagaatggttccatttacagaaattattgtttcatgttagtaccttctggatttccccacaaataaccattttggaaaatgtcaagttagccattttaggctttttacttacttgtctgtagctctttctctctggcctgcacatcagaaaagacttgcttaaaatgatttgtaaaggccacaaagtctgcatccaggaacatgggtccttgtcctttctctttcagggctatgctttgaatttttaatcgttcaatttgaggttgaagatctgatagccggttgacttcatcctgtgccatagagtatggaaagtaagtaacacgtttactttgcatacattacattttgcaaaagaaggtattaaaaagcagtaaggcaagtttagcttaatacccttcacaaatatctgataagaaacatccatgacagtatagacaagcctctatcaccagccatacatttaaggataccttggctctttgttcaatatgtatcatcctatataatgatatttaaatttcaagatgacataatttagagcattaatgggtatgaatgcgtacagtggaaaaatactatgcatgaccttaaatcctttccataaatcaaatataggtgtttggctgcacccctcttatatcaaaatgatgtgcgcttgcttcaaattttaagctcactcaatgaacaatattttctctttcatttctgcaaaatataaattacatatatacctacatatatgtatatgtgtatactataattataaatatattttgatacaattatatagattatatacacacatataaaatctatataatacttatacatatgtatgtacacacccaaatataaaaatatatctataatcttctatgttttgtatggtctcattacttctcctgaccaaacaggcaaccactgcttttttttttttttttttttttttttgggacagagtctcgctcttgttgcccaggctggagtgcaatgacgcgatcttggccaaatgcaaccttcacattccaggttcaagcgattcttctgcctcagcctcctgagtagctgggattacaggtgcccgctaccgtgtccagcaaattttttttatttttagtagagatggagtttcactgttggccaggctggtctcaaactgctgacctcatgatccacccaccttggcctcccaaagtgctgggattacaggtgtgagccaccgcgcccagccaattgccactttttaaattacggtggctgtccaggtttcctcttgttgtcctggcataattattagtagcaccctgtttcactctcagtagtaccctggtttgtatgataaaatcacatgaacactgctgtactgtcactagctcatgtggcaactgggcacctgaaatgtggctggtccaaatttagatgcatgaaattaccaaaatatgtttaattctgaagattaagaaaagctaagaacataatctcaaagtttttaaatactgattacactttcaaataatatttttgatgaatcaggttaaataaaatgtactattgaaattcaattaccgtttctttttcctttcctaatatagtttctagaccattttaaattacatatgtggcttgaatttgtggctagcactgtatttcttttggacaatgactttcttcacagaattggaaaaaactactttaaagttcatatggaaccaaaaaagagcccgcatcgccaagtcaatcctaagccaacaggacaaagctggaggcatcacactacctgacttcaaactatactacaaggctacagtaaccaaaacagcatggtactggtaccaaaacagagatatagatcaatggaacagaacagagccctcagaaataacgccgcatacctacaactatctgatctttgacaaacctgacaaaaacaagcaatggggaaaggattccctatttaataaatggtgctgggaaaactggctagccatatgtagaaagctgaaactggatcccttccttacaacttatacaaaaatcaattcaagatggattaaagatttaaacgttagacctaaaaccataaaaaccctagaagaaaacctaggcaataccattcagggcataggcatgggcaaggacttcatgtccaaaacaccaaaagcaatggcaacaaaagacaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaacgaactcaaaaaaatttacaagaaaaaaacaaacaaccccatcaaaaagtgggcgaagggcatgctattctctacataaatgttttcatgttcttgtttccagtgaagttggaattgtttcgtatttaatacatatataatttgaactcaaagttttcactgccctttttaaaagtgttattatcatggctgcttacttacaattcatatatatgctgtctttagaaaaaaatacttgagggttagttactatttaatatgtaacaacaggaaaattgaaatttaaaaattggaacatgagcccattagaagaaagagaaaatggaaagaattataccaattctgaacgaattgaaatctgagcttcctgaaaatcaaagtgaaaaggcaaaaaaaaagttaatatttatggaggcattcatactctttgggagagagtaacttttgtattaggagaggctgagaaatttatcacataaattctgtcatggttgcaagactaatgtacaatgccacttattctcattaaaaaaacataaatacagctttcagaggaatgtgtttatgtggttataatggtatgagctgattcaggtaaaataatctctgacgattcaatcgttttggtgggtgaagattaaagacgtttagcaaaatggaaggtgacctatatttctctttcaaatataaatcctctcaaaccagtgctagaaagttggtatatatccatggataagaaataagacaagaggtaaagggtaatattctgtatttatagtacagaaatatatacaaataatttgtatgctagatttacaaatggcagcattggcatctactgtgaaccattaagaacctgatttatatttggccagatggagggctgccatttttcccgttcagggggctatagaaagagccaacattatagccaagtgtgctctgaaaaacaaaggggactttgaaactaataaaacatttgggcaaatgttcagttgagaccttaatgttctgagaataaatcatagaagagatacttttcaactgaagtattctgtgtttaaaaagatgtgaacaattagccattatttccataaaaggatttggtttagttggtcctccagagtatggtatctcctttgagtctgtttattctttaaaattatatgcttatctcatggaagcttttgtatttttcacaggaaagggttcatgaattttttccaattctgataaggctctctaacccccacaatattaaaaaccagttctgccgatcattagaatatgagctaaatatgcgctctaatgttataaaacttctccaaataaaataaaacgctgagaaacatgttataatttatttacctatcactaatctcagcagaacagtatatatatttgcccttgtatgaataatattaagcttatcttgctaaatattttacctaaagtgattcttcaaattaatagacaccaatgggtctgagagaaagagtaaggggtgataaggaggtgacaacggaatttggatgcagtaagagaagtattttcccttaggatgacttcctcaacctccagacaatatttaatatataaaacctctggtgatctccatttgttcctcaaatcaagaccaagatactagcaggtcccagaagtcattggtttgtctcctatatacctgactgattcctgtttgtctctcctctcattcatctgcccctctatgttcagcatttacaatggtcttcattcaggtgcttggcctttattgctccctcttgccatgttccttctgcctggaatcttgcttaactgttctcttacctaattctaacttatcacaaaagtctcaactcaaatgttcctccctcaaggaagatgcccttggtggctgtatcaggttcgtttttccctgttactcattctcccaaagctttgcatcttagtttaaaccactgttcctagcaggaaatttaaaaatattgattccattgtttcatatctctcttctctgctttccgtaaatacaataaaagcagagtccatgaatgcccactctaatattcccaaaacttagtgctatgggctgaattgtgtcttccaaaattcacatgttgaagtcctaaccattggtgagactatttggtgataggacttttaagaggtaatgatgtttatatgacgtcatcagggttgggtaagggtggcggggtggggggctaatcccttagggattggtggctttataaaaggaggcagagataaagagagagagaaagaaaaatagccctcattctctctctctgcatgtatacacacagaggaaagccatgtgaggacagagtgagaagttggttatctgcaagccaggaagacagccttcaccagaagatgaagctgaaccctaccaaaccttgatcctggactttctctcacttctagaactctcagaaaataaacctgtgttgtttaagccaccgagtctgtggtatttattgtggcagactcagctgattaatacactcagtagcattcttaaacacattagagacacttaatgtatatattttatgcatgaatgtactgtgtaggtactattactaactactatatctgaatctcaagaatcggataaggtaacatcagatttttgtggcaagaaataatgtatttggattattcctctgattcacaggaaaagcggcattggttctattcttaaattacaaaatgcatctcaatgtagaaattccttagatgtgtgtatttgcctaacaagtcaagtgccttatccaaggtattctttatccaaaagtatactttctgagtttatttcctcagcaaactaacacaagaacagaaaacctaataatgctacaggtccgatatttgaagaaccattaagtccttcaattgtttttctcttcaaaatagctttgaatttctcatcactttttgggtccaataccttttctaaatcaaccttgtcacctttccatgtctattctacctttatttaagccattcttttttacagtatgcaaatgaatctccactccttgccttttgtattaaatgtaatcatctcgatctatcactaaacgttcatcctggaaacgttttagtccatcctctaatcagtttctcattccccgcgaaaagcacatagctcatagtaacaatgaaaacagtttaggctattttcattattatacagctcttgttttcttacacttgaaggcataatcctttcatctctttctcaggcccttttgtccacttacatcttgtttgcccctccagatccactgtccgctcttctcctgttacccaggagactgatatttacagatgacggttccttgtcctttgtcttacgattaagtttagtcagtgaggagccctgacaagattctggaggcagggaaaaaagtgaagtggggtgtttatttgtctgactccatttctatgaggattccttaagccggccatgctgcttttaccatgaggatctgactgtctccttctgagtttctataactgctctctcactgatcctttctggactaaaaggggtaagaactctgatgctgggttactacactatccggtgtggttcctctgtactccagctacattttaaaaatatctttttgtaaagaaaccttcctcaaattatcgtaatttgagaggtccatcagttttaaatattttccttatgtatctagttatactgcatccaagcttgttgttgacccgtgtttctaactatttccatggattccactttttcaaaatgactatgtttcactcgtcacaaagaaagagttccaaagtgagaggccattttttacaggatacatgtggtttccacactcctaaactgcctcatgcttacgcaaaccgacacaatcaattagcgctgtgtaactacgccaaatacaattttagaatccgggtatctacgtcttacatatttaaacagatttctgttgcttacattttgaactttattgcgcttagctaaatccttagaaggtgaacgtttcattactaaataatttgttactgtcttcttggaaattgccaagaaatacctattgattatgctccaaatggaaggagaagagattcttaccttacaaatttttaactgacttttaattgctgttggctctgatggggtggtgggttggattttcaaccagttttcagcagtagttgtcatctgctccaattgttgtagctgattatagaaagcgatgatgttgttctgatactccagccagttaagtctctcacttagcaactggcagaattcgatccaccggctgttcagttgttctgaggcttgtttgatgctatctgcattaacaccctctagaaagaaaaaaataattaaatatatcccctgaacccacagactgaaagaaatgatctgaaagccaacacatcctaattataaaagtattcaccacatgaatgatttcaaaccagatcaattattttctaagatataaatgtgtaaatatgatttcagattattcaatgtgaattatcagacttgcgtcacaacaatgaatatcaatgccatcaagtaataagacataagatgtagaaaattagaatatatgtaaataaaatattaaataaaaacttaaataaaaacaaaagtgctcaaagctctgatgggagctggaaggctgcatgaacaagtaacattttggatgttttcagatacattttacatatcatacatattactcaaatatacttccccaaactaacttacatttttaattttaaaaatgggcttggaaattagtttaaatagtattttcatagttttaaaaagaggaaaaaaaatccaagattattctttatttcatttacagaagattagaaataaacagattgtcggctgggcacggtggctcatgcctataattccaacactttgggaggccgaggtgggggatcacggcatcgggagatcaagaccatcctggctaacacggtgaaaccccgtctctactaaaaatacaaaaaattagccgggcgtggtggcgggcgcctggggttccagctactcgggaggctgaggcaggagaatggcgtgaacccgggaggcggagcttgcagtgagcggagatcgcgccactgcactccagcctgggtgacagagcgagactctgtctcatattgtccatggatgcgaggaagaaaaacaagtactaggaaaaataatctttctaatgtgaaacatttttaaatttataaatgtagaagttgatctcaaagttttaaaatcatctgtagtaataccaaacccagaaaactttatcaagggaaaaatggaaacacaagcatatcattatcaccattaccattctggagtacctactatgtaccatggaatatgctatgtcatttcatatatgacgaacgccagtccaagtacatattattccatacatagcatgaaagcatggcaacatcacgctgtgctatgggttaaaatattcaaactctctaaagttagtttacaaaatttagactttcttagatttattagcttatatagttttcttaatgacagaatataaaagagaaaatatattacatatgatatcatgcatttttaaacatagctacattagcactgataactttcttatactttggaaatactgaatatttaaatgttttatgttccctcatgtacctacagagatctcaaaagaacataaactcactgtaaggttctttctctaggttaaaatacctaaaagttcgaagagtagtttggtagaagagtaggttgcctaagataatctacttttataaatgttcattttacttaattttctggtaatataatttagttaaagggaagctaagttcttaaaaagtctgaagaacgtctctagaaacataaggcctgtggttttgctaacttgcacatgcctcccactttatcctttttaaagactaaaaaaaatatagatgtgaattcaacaactatattattttatcctctttcacttccctctgccctgatagtctaatgttctatttgtcataatgatattaatgctgccaaaccatgtccctcaattcatttgaaacacaactgtaacttcactaatttcaaagcataatgctactcaggatggcggtgaaggagacaaactttgcaaatattatcgtcaactattttcccctccttcttccctgatatatttttaatgagatacaatggaaataatagaatgtaaaaagaatatatacatggctccatatatctaagtataaaagaagtccgtggcctacaggagctacatattctaatatcctcctaatgcttaaggaagcaattgtgacatgctgtttttgatcgttagattttgaggagtgatcaaaaattgtaccaaaatatttgttaagcgatgcgattaagtaactgttgttataaaatgaccacatttggtataaagtgtaagagaagaatatgaaacttcaatcgtatgagcactccgtttgaaaaaagtattatgataaaacgttaacatttctggaaaataaaaagataattagaaaatatactggacagaatttttaaattatgttaataacaaaaaatgtggcatggatctaaatgatcagatatttaggagaaatattttcagcatatgttgaacttgaacaagcagttagaagtccatgaagggtgaaacgtcaacatgaaccaggtattaaacaggcaaaaaagaaatgctaaattaaagggaccgatagactgatgctggattgagtcttattcaacatttgtctaaatgagacgggaacacagagagaaatcactttgtgtccctgagaaaggtcaaccatacaaatcgtagcaaatgaaaaaatgaaactataagttgattttcaatatggatatgttaattttgttaaatgataaaactacagtgaagtaccaataggctctgcagtatccgttaaaatctagggacaggttttaatgagtcattgttgatcattacacaaaactctatgttttgccccccaaaaaatgttgcaatatatcactgtaaaagaaatttaaatggtgaagaaaagtcagctttgtacaaattcataacactgaaatttataatacgctctatttatttgcatattgatctttataactgaatgcaggcaatgaaaatgcagtgataggtaaaagaacgacatctataatagcaaaaagggggaggcaggcagaaaggcagagaaatgaccggtgagaattctggcgttaaagagaccggagttcaaatttgatgccccttactagatgtgtgaaatgggttcagttacttaatttcactggatcttgtttttctcatccatgaaatgaggattaaaaatagaatcgacctcataggatacttaccaaagttctgagttaacatatataacttacttataacaaatgctgacacatactaggcaacaaagacatattagacaatgccatatagaggaaatgaaaaagaatattcagaaaacaagggaccagctctcttgtgtgaaaattagggggagaggaagtcttcttaatgactgaaacaggacatgtataaaaagttaataatactattttaaaattagtcctaattttatataatatatgactaatatgggatatagaaggtgtatttatacattttttaaagaagttttatcaataaccagggatcctttgagaccaggagttcgaggctgcactgagctatgattgcatcactgtattctagcctgggcaacagagcaagagcctgtcaccaactaaaataaaaataaaaagagtttatttgggaatcctggaatattctgccacatttataatcatgtgagattgaagttataaagaaacgaaaacatttcaaaaaaaacgtggaaatttctagatgttactagaaaagacataatgttgggcacagaaaatcagaagtcttgctatgaaggatttgtatgcaaacattgtattaattcattgtgaatatgctgcctgctcaacaagggcataaactgtccttctaaactataaactcctataggaaatgtctccactggcagtatctaatagaattctcagcttggagtagaaagagtataactacactgtactcatgaactcattcaataccaaatcaatagtgtactctatatgaatataaaaattatgagaccaatgtacactgaagccaaaagccatacacaaacaagcacacaatctctcttgtatcaaatttgctttaaaatacttgggcaggggatggagaggatggtcacgttacttactgacactgtcacgttaataaccgacactgtcacattacttaatgtacctctcttcaattaaaatgagaaatgctattacttcaactttatgaattaattgaccatctaaatgccagaactactgttgattttctaagaaagtccattaaaacctttctagaatgaaaaagggttcaaagcgttatccaagtaaatatttgcatatggattttattattatatataattgttttatatgtattccatagaattatgctccttgactcaatggaaaattttaacttttctaagagtttgtaagtgtaaatatctgaaaagttttaagtatcaatcatctgagcatctgttttctaattttgtgttagctatttaagaatacaaatactaacacaccaggcattatgagcaatacttatggaaaccattttgttgtagcacattagaatctcagggataatggatcataatccattcacatctcatattctaaacaacccctgaaatagtctgtgaataaatatattgcacccagaggaaatggatcattacttgaagtgtatccattaattttattacttgtgtacagtgcataacagactgttagaataatgttaaatgtgcaccaccttccatgcaagtacttcagaactgccacttaaagtgaagtattcctcatcaagtatattcatcattagccatgaagccagggtagaataacacaaaacaagtgtttccagagctcttgaattaaaagaatatttggaatagaaacttaaaataaagctgctaataaacagtctcctatttttgctgaactttaagtgagggttattacaagtccatttagcattcaatgtaatagtctaaaatgtaatatagagatattcaaaacctgtgaagacaagttctgaggctaaattttagaggtttctgtgaccacactgacttaaagtaatagcttttaaaaattaatagtatatataaaagtaatacccctagtgagggcaatataaattttactaatatagcccttttgcgtttttattttcaaacatcataaaattaaaaaaagtcagatttttactcatatttgttttggccactcatttcccacaacaacagtgacaacaacagtctctttctttcacacacatggacacacacacgcacatgtctgcgcatgcgagttcacccgtgcatgcacgccgtgctcacacacacccacagaggctcttccttttggagattagacttaaacgaagaaaaatgtgcctgtcaattaaaaacatttattgaatgtgaactctgtgtagagcattatactaagtgtcatgtggagaaagaagaaatataaatcaaactgcccagtactgaggaaggaataagagaagaggaaatatatgcaactgtggaaggctactcattcatgatgaaggggctgggctactacaagtggtacagtctccatgccacatttgtatacagactatttgcaatatgtcttgccattaaaatatatgattagaagacttgctgctactgaaagtttttccagtgatcatgagagttttagctttgagatgagccagactgaccataatccctaccctcacccatctgacaaaatctggttgcccacctcaaataacataattcatgtgaaattatctaatgagctatgaaccaaaatacaagaaaaaaagatagttacttggttaatgttatggataagaagagctctcgtcagtgttatcattctgtgccatttaattacaacagttagcatacttattatcaggtatcaccttaaacactataatctagcactcagggaatgatagttttgagatgttctttagtctaatatactaataattactacttttatttaaacatgtccttgatgtgactgtccttagactcttaattaacacacagaaaactacaaatagaaattgaaaatgaatcacaatttaactaaccctattacataattatagtatctcctctagaaattatggtgaaaggatcttagagactaaagaacgagaacctgagctacgcctacatatgttttcaaataaatgttttgatatggtcatcttttggtaatttcagtattaatatggaaaaccagtttatctaaactaggcttttttgtgttatgcctgattgatgagactgtatgtactcatgcgagaacactgttttacaaaaaggattacgtctaatcctaaatagataaaaacagacatatgtttaggtataatcatatgtatattattttagccctaggttgtcctaaaactccacaatctcaataatacactgaaaggccttggtcatgaaaggcatcagtttaaagactgttcaaattaaaatcttagaaaaccattattagttagcaatattattaaagcattagaaagattacttactatatttaatggctaaatttttctaaatttctaaattatttataacattttgtatttaaattaagaaatgtaaaaataaaccttaaagttatatcacatctttcttaaaaagtaaaataaagaatttggaaactcccttttcaatatgcacagctacatgaatatataaatacatcactagatacctggtctagcctctcacttgccctcattaagttaacagtttcctgagaccagggttatgatccaaagcttacatattgacggtaagctgcatgaaaattacagctatccaaaaatgtctctagtaaaaagaggtactttgcaccatccaatattctgtcacatttatccaaccaattaatgctgacataagaacagtaaattaattttaatgttagttcaaacaaaaaatacagctaagatagagataaatcagttaaaaattataccaaaatttcatgccaaaatgccagaaacgtgatttttttttttagttaacactctccttttagtagcttctctttttagtctatgatcgtgaaagatcacttctactctgaccaaaagaactggaacatccataaggaaaacgtccatgtatagttttaaagcaggcaaggaatttggccaactcatttctttggttaaaaattccaaataaattagtaagaatctcttacggtcaataaactcttaatatacaaattattgctgtaaaattaatgatatggttaatattaactgttttaaaattctgcatacaactcttcacatttgataaaatacagtgaaaataaaaagtatcttccaattgatcataaaacttgtatgtgacactgaaaaactgtacatatgttactagacatactgtttctagaacgtacaactgatttttaacaatactttgcaccatcaaatgaggttcccttctacattgtaaccatggtaaattttgtactttcaacaaccttaacaccctatcctgtcttctcagcatatgtcttaaattccttcaacaaattgccttcaggacaaacagattttgttttctgcattacttaagtgatgttgaatcttcaatgcttcatagacatttagaaacggacagaaatcatttggaaatatgtctgatgtaccatttcaggtcaaaactgaagtaaaatttaagttatgagaaattattttttccatcttggaatttcattctaaaagcaaactgatgaattacaaaattattctaaatttttaaaaagtagtttaatcttagggcaaattattttaagtagaaaattcagtttgctatgcatataccagtatagatacatataaaatatagttcacagaattttttaaaatctataatagctatacttatgctattctacatatttttacactatgaatatatgttaaatattttcactgtggtaagcacacatcaaatttataaatatatacgcacatatttttattagtggcataataatatgagtggtttatacaagagtggttcatctttatcttaacttctgaggaaactatacgtggttaagaggaacagccatttacatgaggtcctaaatgaagcacactgattcagctctcattttcctttctatacaaaaagggcaagaatgtatgtgtcttacgtggttgtgagatttattatatctccatagcctaagcttgggaaggaagattctggacttataaatttaagagctttaatgcaataattgctggactcctagtttacagaaagcttcatttgtctttcagcttcatgagctacaccactcaactgtacttttgggctctatactaaaggagctattatgatttagggtagcagtccctctgaaatacacctgaaggggtacttcaggcacttaatatgtgtctagcttatctcacaatttgcacaatcacagaaaataaatattatgcaatttgttccttgaacgacaaaaacggaacaaatagataagttagaatatttgagcctttaagtaatttcataaattattttatttaatggggaaacagagctatggtcattttaagtagtcatcctagttatggcccaaacttgagcctaatgacgtatcagttcgaccatatctttactggtagaacaaaagggtagcataaaatttgattaacacagtcaaccaaacaggaatgtctcaaatcacacccctaccccccagtgttccctggtatctgccaaagttagcattttccttcagatggattattattttcacaccaaaattaccaacgttattacctcaacgactgccttaattttgcttttctaaacagaatctggtcaattaatatttactaagcacctactatgtgtcctgacttttctacatgcctccaaaaattagaactatgagggaaataatcaagaaaattaatattctcactagtcacacgatcatttaaatcctgcatgtagttttacttaccaaaaattaaaaatcattcccgtaatttctaaatgtttaaattatttctgattaattcagtgtaggtaagcttgatatataactatgacatgagaccatttaaagtatagctcttgcatcagcttattaaaatgaaaaagtgataatacagtttctagggggaacttacataacaactaggagaatatttttagatcacataattttatttaacatgaatatgctgttaagttgatcagttaaaattaccaagcaacatacatctaaataaaaatctactggtattttcattacctgttcttaaacttgttcactcaagtctcacctgttatatttgtttgttttcatttttaaccaaatacagtcagtcatgggactcattagaagaagaaaatgaattgattttctaggaagaccactgaacttttgaatgccaaatttgcaattaaggcaaaaaataacttatacacagaatttatgccccaaaatgcaggcagattctgaaaaaagctgacatgcacaacaaaaacatttgttgtatttatttatgatgttcttgtaaacgtcttctacaaaatgaaaaataatcttatttggaaatagcattatccctgattttcgtaaaattttatctggaaatatagtagtatagcaatgataatttgaaagaaggttgtttacatatcatgtcaatgacacatttggtacacataacttttgaggcactgagtattagaaaagattaattttaatttattcttgaaaaagaaagacaaaaacttggctagctttgtgcttttatctcactctaaaaaagttacttaaaagtaaaggttatcccgaagagacttcttttttaaatgagaggaagtgataaaaagtaacacagaaaatgtcatatatattattacaaaacaggaatgacggtaaaacattccatataattttagtgtttggaaaaacatattgcaaaaatgatttaaaatcagatgatgatcagttttacacatataacatgactgttaatgttttcaaatttctgttaaccttattttcttaaattatttggataaattctagcagatttgcattaaaatttatttctctgctacagactgataaaatattctaccacatcccattttcttccaatgaactcaaagttgaatttctcctaataatttccttagcattaaaaaaagaataataaaaaacatacaaacaccttttaatttaaatttgtatttaacaagtgcttgtctgatataattcagctgataaatatgaacctatgtgtttatcaaatccctaagaagattatctaaatcaactcgtgtaattaccattcaccatctgttccaccagggcctgagctgatctgctggcatcttgcagttttctgaacttctcagctttttctcgctctatggcctgcagcatgagagcaaagatgagtaattcaatacaaggactgtgaatctacacaataattataacttctacttgccctttcaagccttaagatgtttcactctgtcagcttatcacgtgaatctaaagactttttctcaacacttttgccatcaaaaacatcaaaatggcaataaaagcatgagccattttcatgacttgctacaacttttaattataagatttctactcagcttttttttacattatagtttctgatacatttcaacgcaagactgcaaaaagtaaaaaggcaattcataacaatgaaagataaagtgtcacataactaaaatgaaatttatcttttaaagatacaccattgaaattactaataagtatataggcggtattaaaaatcaaattgagaatccagtatgtatataagatggaaaaaataaactaccataaataatttagcagaaatatataatatatgtacatatatatttaaataccaggctgtaggctaatttttctttcaaaaataatcaaagtactcctatttccaaggaagacaagattgagtttcaaaaaactttctgaattcctttatttcccttaagagttacattttgaaccacaaatgcaaaattatttcagttaacaatagccagaatttcatactattgagtttagctaataatattcctatggagacataaattttaaactatgacagagtagaactacattactataatcatcaagaagtgttgactataacaatgtgtatgtcctaaaacataactattcaaataactataacgcaattaaaatatagtaagaacaacacacctgtgacttaacaatcatattataacaaagatttctcttgaatttgaggcagaaggttattctacatgagactattttttaagacttcatttacatccacaggcatttaaaaaaatatttccaggtaaaatactggagtacagatgggagggcaaataacagatacatggacagtctgcaccactgttgagtataaatttgtgcagggatggaaatgatctgtatctgtgtcatccaatatgatagccaataaccacatgtgggtattcagcacttgaaaggtggtcagcatgacttgaaaataaaagaatatttaatttaatctaattttatttattttaaataatttaaaatttaaaggttacatgtgaccagtgttaactgtgattgtacagcgcagatctaatacattcctttaaaagcaaatagttaagagataggcctgtaatccgagctactcagaaggcctgggcaggaagactgcttcagtccagggatttgagatcagcctaggcaaaatcgagagacctccatctctaaacaaacaattttaaaaaattagtcaggcgtggtgacaggagcctgtagtcccagctactcaggaatctgaggcagaaggactgcttgagcacagtagtctgagtaggctgcaacgaactatcattgcgccactgtactccagcctgggcgacagagggaaactctttcatataatatggcaatatcagaaatagttgcagagaaaaagtaatcatctagacaacactatttactaagcacattaaattatgtaaatgcttatacaataatccacatatttttatgtatctgaaaagactatctaatttaaagaaatagctacaaatgtaaagctttttgtttttgtttctctttgagacagagtctcactctgtcgcccaggctggagtgcagtggcatgatctcagctcactgcaacctctgcctcccgggttcaagcaactctcctgcttcagcctcccgagtagccgggattacaggcgtgcaccaccacgcccagctaatttttgtatttttagtagagacagggtttcaccatgttggccaggctggtctcaaactcctgacctcatcatccgcccagctcagtgctggggtggggcggggggattacaggtgtgagccaccgtgcctggcctgaataaaggttttcttaaaaatttattttaaagagtttcctaagtgggagacctgacgatatctgacttcaaggcttgatataaaactgcagtaatcaagacagagtaatattggcaaaagaacagacaggtaaatcaatggaacagaatagaaagctcagaaacagatccacataaatataatcaattgatttttggcaaaggaaccaaggcaatacagtggagaaaaagtctttaaacaaatggtcctgaacaacacaacatctacatgcaaaaaagtttatctaggcataaaccttacacccttcttttgttttaattacaattatttaattccaatttatttactttcatgttattcactggatcaacttcattggaagtttatacttttgatggtgaaatatctgacattattgtgaattttatcacaaattcactttaaaatttcaacattgaatatatctgtacaaatgataacatgggctgggtgcagtggctcacacctgtaatcccagcactttggggggccaacgcgggtggatcacctgaggtcgggagttcgagaccagcctggccaacatggtgaaaccctgtctctactaaaaatacaaacataattatctgggcatggtggcaggcacctataatcccagctactctggaggctgaggcaggaaaatcccttgaacccgggaggcagaggttgcagtgagccgagatcacaccattgcactccagcctgggtgacagagtaagactctgtctcaaaaataaataaataaaataaaataacatgaacatatatttttgtggaacacagcattatggttgaaaaccatgttttcttggatacacatggatataaagatgggaacaagaaacactgcggactactagagtggggagggagtgaggggaaaaggtccaaaatagtagctattggatactatgctcagcaccaaacctcagtgtcacacaatatacacacgtaacaaacctgcacatttactcttgaatccaaaagttgaaattataaaaaataaaataaaaatgaaaaataaacataccaaaaataaatacatttccactgaatttagaaatttgtgtaactgcttgaaagtaattgtggtgttcatataattcataaagttaattaataatgaatcaatcacagactctagagtaaaatgtaaaactataaaactcctagcagatagcagtggagaaaacagaggtgactttgagtttgttgatagttttttagatacaccaccaaagggatgatccatgaaagaaagaattaataagttgaatagtactaagttaaaaggttctgctctgtgaaagatgctgccaaaagaacgaaaagaaaagccacaggctcaaagaaaatatttacgaaagacatatctggtagagaattcttatccgaaatacacaaagaactcttaaaactcagtaacaaaaacaaacaaactaaaacatgggcaaaaatccttaacagacacctcaccaaaggaagtatacagatggcaaataagcaaatgaaaatatgtttcacatcatatgttaccagggaattacaaattaaacaatgagataccactacacacctattagaatggccaaaatccaagaacactgacaaaaccaaaagccgacagagaaatggggcaatgggaactctcattcatttctggtggcaatgcaaaatggcacagccactttggaagacagtttggaggtttcttacaaaagtaaacattctactatatgatccagcaatcatgcacttaggcatttacacaaaggagtcatatgtccactcaaattcctgcacatgaatgctgcagcagctttgtttgtatttgccaagacttggaaacaatcaagatgttcttcagtagatgaatggataaataaactgtgagacatccagacaatggaatattattcagtgcttaaaaatgagctatcaagccataaaaagacatggaagaacttaaatgcatgttactaagttaaagaagataatctgaaaaggctatatattttaccgcaggatttcaccctagattccaattccgaatatatgatagtctggaaaaggtaaaactatgtaaactacaaaacaatcagtggtttctagagattaggagagaagtgtagatgaacgggaaaagtattgaggatttttatggcagtgaaattacaccgcataacactctaaagataaatacatgtcattgtaaatttgtttaaactcacagaatgtgtggcaccaatagggaaagctaatgtataaactatgaactttgggagataatgatgtgtcaatgtaagttcatctgttgaaacaaatataccactctagtgggaaatgttgacagtggggcaggctatgtatctgtgggagccgggttatatgggaaatttttgtaccttctgttcaattgtgctgtgaacctataattactctaaaaatggagtctattaaaatcacaaaaaaaggtttcatgaattaggaatactggattcaatatcaagagtacaaaatgctaaaaaaaaaaaaaaaagccaatcattcacagaataaactccatcaggaatagctgtaatatataaaatactaattaaaactgagaataaattaagagtaaaatttaaaaaaaatctataaggtagtaattttgttttattttcttaaatacctatctcttagctgaaagatacacattttacatggtgctctgaagggcaacaaatgaaaactcagttttgtctaattagttaagaaactctgaaagtgacagacactttttaatatcttacattccacttgaaaatttcaaagcacccagtttgtggtattttgtgattttatgttcccaggatccctttccaattagcaggtaaaacttctgagttgtcttgaaattcagtttcacaaagacagtattgaattgtttccaggaacgtgcacaatcatggatggttctaatttgttggttgaactgaaaagtccatgaaaatagagtagctacaacatctagttaaaagtaagatcctagatgaagctccaatatttctattttctcaacttattagtttttgtgatctaagttatctgtccttagcagcttatggcatacttgtttttcactacttacatttattctccattaaaaggtaaatgttatatggaaagcaccctgagcatcttagaggagaaaaaataagcacatttaagtaaatatgtaatgtaaatatcaagaaagacaggaggatttggggtgtccagaatttgaactttatccagaaaacaatatacagatgaaagaaaaaatatataccacaatacaacacataaaggaacaatgacaacaagctgagtaaagtgatgttctttgagttacttttagagttatcttctcctatcagaggggtttctattttatctacattgagcttttgctttagtttttgtgaaatgatataaaaagtagaatgagaacactatgtggtctttataaatattgaaaataaattatcaatagccctctaaatgttatcatcataatctctttattctaagcttactagaatcaattaatattactaacagagaacaaaacttatatttgaatatctcaggaatcatatttgacctttaatatcttgttaaccacattgttccagttattctaatataaatagtctcagtaacaaccaccacaactacaacaaaaacaataatctataaagtaggtactattactttcccattttgacagaggagggaagtgaggcacagagaggtttgtgaaaattttgaaaacaatgcaatagccacattgaaaataagattccttatactaccaaattatagtttatgtacataatttccatatgtatgtcataataattgtaagaaagaagaaatcagcattgttgtataccattttatacaagagaaaactgagcatcagtaagattaaatcgtatatcaaaggtcatcatattaggaagttttagattcaatattagaaccctgctcttctacttataatttcagctttctttcagacatgctctgctgttgctaggggtatttcaatggatattattcaaaaaggtgtgagcgtatcagaatatatatcagagcaaacagagcttatagtttggatgtattagggatgttcaacatatttaactattaattcagcagggccaacaagatatcacaaggaatgccgggtcactcagaatggtctctgacagtctataggctgattaccaactctgtatacagctcaaataaactgaataactggtgcataaagagacacatagaccccagaaagaagcagtcaatggtatctgcatatttgtcaatgttcagacgatatctgggttctgttagggcacattactttcaagaggaacattgcaaaatgaagaggaatatgcatacaagtatgccttgaagagtgtgaatgagacagtgaagagcccagaaaacatttcatttcagacacagctgtagatagttgattaaaaataataaaatttagtataacaaagagatgttaaagaagatactacaacaaaagggcctgcagtcaccctttttgctctgctgttatcagttctgtctctactgcttactatctgtccctaataaagtacttcgacctttctgaacctcagtatttcctatgtaaaatagcaataaagatacctaccatgtgggacttctgaggggattaaaggaagctcgctatttatttcccaaaatgagatagtttttatagtaaaatggggagctaggaataattaagctgagaaaaatggtttgacataagctaagactatacccgacaaactgaaatatgtgctcattctacttaaaggtaacttcaataatcttaaaaagaaatttaggaaactttttttttttttctttttgagacggagtctcgctctgtcgcccaggctggagtgcagtggcgcaatcttggctcactgcaagctccgcctcccgggttcacgccattctccttcctcagcctcctgagtagctgggactacaggcgcccgcaaccatgcccggctaattttttgtatttttagtagagacgaggcttcatggtgtcaaccatgatggtcttgatctcctgacttcatgatccacccgcctcgacctcccaaagtgctgagattacaggcgtgagccaccgtgcctggccacggaaacatttttgacacaagagatgatgagagtaccttgttcgtggaaatgtccaaataaccacatataaaaagtgttaaaaaaaaaaaaaaaaaaaggttaagtaaataaacatcactgaaaatcgccatttctcctgggatctggccacccatacgttcgtcctcaaatgaaatatatgaacttctgttttcaggtaggttggatcagtagttcctaaaatttctaccgtctcccattaactcacagaaatatacattaaaaagcacagaaaagcacaaaaaccaaaaacaaagtctaaagagatatattttgctgaaaaaggaagataactgtcctcattttaagtgactgtgtatcaacaaagaggaacataggccttccacaggtctatcttgcaaagtaaaaactggttcaaaacaaaaacaaaaactggctctcacatctattctcttactcagtcccatcaaaactgctcttatcagtctcaccattggcccccaagctactgcattcaatgactgatgttcagttctcactttacctatcaccatgatttgattgagaggattcctttttcttcttagaagtatttgctaatttggcttcacgtactacttgaacacagttttcctccaacttcagaggtcacctttcctccatctcctttgcaggttcctaatcatgtccctgagctcgcactttggagtgtcctaggcctcaatctgtgttttcctttgtttaggccaaaaacagaatcctccactcccctctctctctcaagcctcacattcaatccatcacaaagtcctgttggctctaacctcaaaacatagccagaaagtgagttatcatggtgctcactactaccacattagacaaagtaccccatcatctctgaggggtatgaatgtttcaaaataggatactaaaggtctttatatttcaccctttgttctctgattatatattatcaacacagcagacagagacaacaggattcagctcaactcgctgacagctgaataaaagctcaagtccttaccatggtctgatcttaattaacttccttaacctttctgaattcttctgctgctaaacatcgtgatttttctgctgcagccacacgcttaccttttccctgatgctacaggcatgctgctgttacacggctgtgcatttatttttccccatgcctaaaaaggccctaaattacttacttggacattttcccccatcaaatgccactttttcagctaggccttttagtgccactctgtctacaagcacatgcataccctctcattttattctgctccttggaacttatcactaacattccacatgctttacatattagtcttgcttcatttccatctttcccactagaatgtaaactatataaggtcaggtatccttatctatatccttctctactctatcccaagtctccatgaaagtggctggtacattataggtacataataaggcgagctctattttagcgtaacgcgtccatatacaatattatggtctctccccttacccacaatgctctcttaaagtgcaaattcataacgaactctaatagctttatataaagtggccataaaaccagtacatggggacaggtgctgcaagctcagtaaaggaaggatggattaaatcaaagtattctagaaactgcatattagttagggagttgggcacatccatcttttcttcagctcaagtcctgatactggtaataaaccaatacctaagtagaaaagaaagagtaccatatacaatccatgagtcaaaacttggtagaatcttacctctctgtttttatttcatggctctgatcttccacctcctctctctatgtgtgtgtatgtacatatatgtacatacacatacatactgtatatatacccctttcccatgttttcaagaccaagggtatcatctgaatactcttcaaccacagtcttcattttcttttatatatttcatcttcaatgaaatttggactaatattaccatattagtccaaattccagtatttcaatattactccaaatacctacagtcagacttcagccttcactactgtacaaaaagttattttgtgaaagtcattaatttggccgggcgcaggggctcacgcctgtaatcccagcactttgggaggccaaggcaggtggatcacaaggtcaggagatggagaccatcctggccaacagttgaaaccccgtctctactaaaaatacaaaaaattagctggacgtggtggcacgtgcctgtagtcccagctactcgggaggctgaggcaggagaatcgcttgaacccgggagacagaagttgcagtgagccaagattgcgccactgcactccagcctgggtgacagagcgaggctccgtctcgggaaaaaaaaaaaaaaaaaaaaaaagaaaagaaagtcattaattttcttcttgttaggaaaaatgcttcttacaacattcagtactgataaaaactacaattacctcctcgaaattgccatgttcataaaaatacctctgcccttgacaatattatctttctcttaaatttcgtcctcatgaagtcatccagcttttctgtatgtgtgtttttctatagagctgtttatcatatatgtgtctacatgcatatacatttttaatcttgaaaggatctatatttcataacatacagtttttaaattatgctattaacatatagaatactaaatactttactcaatatatgcttaatatatgatcacatgtttagaagccactactcggattctaaattatttagtacacataatttcaagtaaagtatacagaagctaaaaaaggcatcagtaaatcaatgtatcagaaatgagtgattattgtgggctcatgaaaattcttagagatcatgaagaattataaatactaaaatgggtaacctaaatgcaaaataaaaggcaactaagttatataatattcaataaaaggaagaaaagtaaaataatttgaagcaaagaatacaacacagggaagttcacaaattcctcaataagttgattaaaacctctttcagacctctgttcctccttctttattagcacctcttaaaagcctcctctttctgtatcttctctaacattatgaaaataagttatggatctctatcagtcctactccgacattagaagtaattaagaatctactcatttaacattctataatgaagttttaccctttgactgaagagtaacttattcactcaaatgtttattcagaagttgttctatccttcatattggtaatagatcctatcttaaatgcaactgcagaactgaaaaaaatcacatatccatatagttaaacatttattggtttgtgtgttaggcatggggacaccaaaaacaaaacacacacacataaaaccaaagccacttcacgttcaagtcctgatttctagaaaccaacaatggaattgaaatgaaaatggctagaaattagtttgtgcaagtaaacaaaaattagatcattgtaggctttaagagggcaatatgaagacatggactttgtcaacactcttcagacaaagaccactggaacatatttgtaggttatcaaagttaacctgatttacacgctgcaacgagagagacagcgcatcacagggaactatggggctgtctctaagagtatgttagaaaaagcttattttaagatgtgggcttgtgttacatgatagggggcatcaaggaagtggggctttgttttgattggatgttgtaaggaagtagggtaattctatgttgagtgtcctaaaatttttatctagatggcaggaggaatgcagagaggctaaagctgtgtttagtaaagaagcataatgtgtcacattaatgaagatgagggatatttggtcattaggcgtggtttggacaatgctattcttttttactgtattaagatatgattacaaagtggtcttgcttttatcttgattcatcacaaccatagcgtgtccctgtatgatgctggcatccctagcaattatttatattcaaccagagaacatcagactggctgcaagtaccaaggcaacatctagcagttccaaagcctaactgaagtgccaagccagctcctggctatcagtagctgattttatctttctcaaatgattataaacacagacataacaagatcatactgaggttttaatatgttcgctttggcagaggtgatgtggaaacttctaaaggaatataacattagtagcagggaagaccagctacaggattgtcatcttaaatagaagtaagccatgatattagctttaatcagggttttggtgatgggaatagagagaactggacattttcaagagctgttaagggagcaggattaattgaacctgtcaaagattggacttgtgaatggtagaagaaaaatctaggtgacccagttcactttcaggtttctggattaggctgtttgcagggtgaaaggaaggagaaagaataaaggaggtctggggaaataatgagatttaagatatcaggcaaacatcaattaaaattgtctattaggcagtcagatatatcaccctgggttttaagaaagagatgagctaaagatacatatgggagaagggttcatttgaaaatagacactatttgaatgggaatgaatgaggatatccagagaagaaacacaaggactctgaagaatatcaatattaaagaaaaactgaattggaacaaatggccaagaatgtgaaagaattaatcaggagaaagcagtatcccataagccaagcgaggaaagaatttcatgagggaaaagaggttaataggttctagttctacagagggattgagtaagataaggcacgttaagtattcacatgcatgtttataggagaggacacgttctaaaagatgaaaacacaaccggtttaaaagctaatgataaagacctgggatgtagatttttgacaatctggatatacagctgaatggaaccaggtggcttaatacatagtcagtgatgctgctgagaacacacacccagagatgagcctcaaccaggtgaaggatagcctcttccactaaggcaggtggaaaaaaaaaaaaaaaaaagatactatgagcacaaatacccacaatttgagaaatattatttcgactaaagtaggagatgaaatcatttactgtgaatgatggggaaagtttaggtaccccacaaaagcttgaaataattgttgagagaaactaagttgaaaatatacttaggatgcacggaaagcttatgaagaactgctggttttgttaaaatatgttgttagtgccgggcgcggtggctcacgcctgtaatcccagcactttgggaggccgaggcgggcggatcacgaggtcaggagatcgagaccatcctggctaacacggtgaaaccccgtctctactaaaaatacaaaaacttagccgggtgtggtggcgggcgcctgtagtcccagctactcaggaggctgaggcaggagaacggcgtgaacccgggaggcagagcttgcagtgagccgagatcgcgccactgcactcccgcctgggacagagcgagactccgtctcaaaaaaataatcttattaaagaaatggagtaatgcctgacaatgacaacatctacatacatacaatcatgacagcaggtagctgaattgaggagatgagagaaacaacagcttttagtgatagcaggagagcccacagggatgctgaaataactaagaatgaaagaacaaattggttgaaaaaatctactaacctagtgccaaagtcttcaatgagaaaatatgataaaatggtagataagagatggccagaagtcattaactgcaaggaaagaggtatttttacatgaagagagcagtatctttggaattgtctctgttaggtgagggagtcagtcattctaaagtagtgggggtacaaaagagggatgagtcatagtgctgttttcgagggtaaaattggtttccacgtatgagtagaataagtatatagaaggcttgtcttgaaaaagtgtttgagcctgccgagtgagagtgtgggaaagcagaggaagtgaagcaaggaaaagaaagtgcaatagagcagagagagaaagatagaagaaaatatagactcgaggtacctatactctgggtagtaaacacagataacagagataggagaaattggaagcattaactggcttgatgatttccagcgggagttggtaaaaagttgattctgaaagagggtaatcaagtgcagatccgaggaagagcccaaagccagatgaccataacgacttgatagggagggtttcaagagaacctcacagaagctccagattttcagacaccttatcaaatccccttgtgatcaaaggaggctattttttttgtttgtttcattaccaatttgcgttaccatgtgctcacggaaaaaattcgagttgttagaatctgttaattcagctaaaaagtctgaactgcagtgatactaaaagaatgtgagaggtaactgctacgtaaagcccaagattgtgtcctagaatattgattctcgagcctttatgtgcataggaatcactcctggaaaatgttcaaaggcaaattttgatttactagttctgagattctatatttctgacaagctcccagataatgtcaatattggtggtccagggacattttgattagaaaggtcccccagaagtcagcttttaaataagtgcattttgttaattatatgaataaaacacatggtgaatatacaaggaaaaaattatgcttaggtttaaaagttgcattttttaaaatatgtgaaattgaactgataatggcctatgatatgctaactggctaaaagcatttgaaaggagtaaatgaagaaatcaagtgaaaaaaaaaagagttggtaatatttagccatttttaatgaaagcctaaaaatggattaataccactcaagttcatgacacgagcctgccatgagtttaaaataacctatataaaccgacaggtgatgtagtaagaaaattaatggatacctaaactgaatatccatcatcgtaattatgtatttctctcaaggatttttaatacatatacattgtatttagcctgagggaaacatcaaggtaaatcatttcatgtcccattttagtaggcaattaagaatgatgttgttatttcagaaaatgagagttcaggttgataaaggggactcacaaggtatcagaaaaccagttataaaacactgtacatttttgagcacttttagtctgtcatgctcccgctattgataaaatgcaaatcgttcataggtaaccacatgataacaggaacttttaaaatttatattcctgaaatactgaaactcaattttcctgcctgatcaaagctgtcttaagataaagaaacagagtatcagacagaaacctgtgagaatcagatcaataatcatttttaattagctaataaaatgctaaaggtgattcatactttcagtggtcaaatatgtaacatgatgtttgaaaattagagtttaatgttctctaattaattttctactactaagagaatttccctcaaaaatcacagcaaacaatttaccttcaaagaagtatacttgaaaaaagacatttagctaattttctacaattatatattatctttcagttttcatatttcccatttcttgaaacaatttagaatagtctattataatgctgacaacagcatgtcttataaagctaataagtaatttaaaatagctttccaatttataagtagttaactctaagaagaactggtgacaaaattgtcttccctttttcaagcagcctaaaaaatagattttttttccagaatatatatatatcttttgttgatctccaaaagttccaaccccaacagcaaacattagcttgtaactgaggtaatgtcgtatttgtaaaaatacaatggattttgaacttcatgatttgaatcctggagagaaaaagcagagctaatatacacatttagatgtgatcttcccatggataaaattacttttcattcataatcactgcttccttagcttgcccattttatttactctgcctgttagaaattattttacaaactgttgccaatcatatacaaagatgcatgttttataattgttgaagttgaaaaattaaagccttgacaatttccctaaagatgaaacactttatattaaattaataaaacttcctatttgtgaaggtcaaaattataccatctcagaagggaataacaacaacaaagcatctgctaccacatgtaaatactgagaaaggctggacaccttttagataaggtaatacacaaatatctgggaaatttaaatatcttataatatatgacagggattgatgactataaagaataactttttgataacagtgagaatatagacatagtcctaagtatggtatctattatattattctattctattttactctattctactctacacaattgtgcaagcttgctaaggcctagccttgaggtaactgaacaatatatgaaaggaatcaacatgaattaatgtcataaaattgttaatttatagttaaataatatgtaagttaaggcaagtttatgaaaggcatccctagtcagtcacagaagaatccagaaagatttctctaggctaaactttgattttgcttgctatctaaaatatatttttaagacatattaaacagcattttatcatatcgcattaatctatcaactagtagaatcacagataacaaagcacggagtttacaagcagcacaaaatgagtacagatataaaaattaatgcataacctacattgactttttcttttaagtctgagaagttgccttccttccgaaagattgcaaattcaggactctgcaacacagcttctgagcgagtaatccagctgtgaagttcagttatatcaacatccaacctaagacagcaaaaaataaaagtcattatttcttgattatctctttcttctatattaaaaaaagcaatttatccacatttatcattcttttctcaatctgagactcctgcctgacacctctattagtattaatagcagcactattttccctgttaggtagactcaaatttggagtcagctttgatctagagtcttatgatcacagaggtcattttattcacctcaatgtaaaaatcacttctacaatatatcctgtaagctattacccagcctctgcttgaatgtttccactatttgaaaaagtactacttcccacgataaccttttctttttggaaagtatttatgagaaaaaaaaaattcctgttggtggtcaccattgaaacacatgcttttctgtagtctccaatcatactgcctctgggtttggccacgtgactttctatcacaaatgggacaatagtaagagtactgcaagtaaggttttgagaagtgcttgcatgtcagagcttgactttttagagcacacattctgagaagacaacaattatataagaagtacaatgaccttgaggtgatcatgttttaaggaaacttgatctgtccatgtgaagaggccacatgaagaagcatggggcaccaggcatgcaaataaagccctctgtgacccatctcaatgccagctgaagacagacaaatgagtgctccagttgatgccacatagagaaaagaaatacccaaagggcactgcctacgttgaagaattaggagaaataataaataggtgctgttttaagccactacattttggtgtgagttgttatgctgccataaatatcagatcacctatcctgttattttcaaacctttttttttttttttttttttttttttggaagagatctttggagccaccagggataaattattcattctaatctggtgatttaggtatagaagagccaaaatatggaatcaacccaagtgtctaatggaatagtattaagcctttaagactatgaatagcctttcatttgcaacaacatgtatgaacccggaggaaattatgttaagtgaaataagccaggtgtagaaagacaaataccacatgatctcacttacaagtggaatctaaaaaaaaaaaaaaaaaaaaatcaaactaaaagaaacagaagacaatgttcatttccaggagctggtgggggtggagagtagttggaaagatattggcaaaaggatacaaaattataaatatttgaaatccgctctttaaatttatcagtagatacctgatcatcagcctaccctatgcttaattacttcaacggatattctatggcttgttgttatcttagtttccttaaattgggtacttaaagggaacatatcagcagtgtgtaaaataaacagggaagaataattatctttctggtttataatactttcattgatatagcccatgatttcaataaatattttcacttcaatattagactttcaactcacattgcaattcaattgacttaaaacttctaggaattttttcacataaactatcattaaaccagttatatcacaacctaattactatcacaaacatatgacctgatctattgaactccagttttgggactttgaatcatataaaccagttagaatttctcacatttgttgcaggctattgtttaaaaattaaacagatacagaaattaatggaacacaaagcccttagaaaaacatattcgcattttatattctcacaaaattctttggttaggtatcaccaattccagctgcccataggatgagatggagcttcagagaaattaagttaattgacctcaataccatgggtcagaaacttgacggttcatagcatacagattgagttgttatttatcgaggctatccaacttgaaattaagagactagggatcctgattcctctaaatcccatgtcactgaatgtcagtaagttatctgtgtatgcattacaaatgtttatggatttttattgtgtcatatatgatttttatctttcctacattttttatccacaagtttgactatcaggttcctgtttcttcattcataatgttgattaaaatatacagtacaattatatgctgtaaaaatctttcacactctcttcagcgatgttaactccttaaatactctcctactatggttatttgattacctacccaaaccagtgaattatatttcaatcatcttttatgcatatttatcatcataatgtcttaaaacatttttatttttgctttggcccaacataaaatttcctgtgtctctctatctgcaagcatctatttgccagtatattggacagagaaggagtgctggaatgttaatactttaggggtgtcccttaaccagtgagagcttggaattggtgaatttcccagctcccttgcccctcagttggacaatcctgaagtatgatacacagtgtctcaaggggttccctgcatgattgagccccagttccttccagcagtaacctgatccctatatttgtgccatactttattggctgctttatttttcttatttcacttccctactttgtttcctgggatcactttccaaataaactgcttgcacctaaatccttctcttcagatctactcttggggcaacccaaactaaggcaataatcaacagcctcaaatgaacctagcatcctgccatacttttttttttttttttttttcccaagttgggctctaagtctctacaggaactattaaaaccttttatcaaagctctggcccatcctctttctgcagctctctcagatgatcttgttccctaccttacagaaacaagtgcaattatcagagtagaacttctttcacttcctatttccaaacaccatcagacccgcatatgtagccaccgttctcattcccttcttttacatttgagtttcccttcttttaattaaagtcattcccactacctacattttgaactttattctcttacttttgctcaagcatctgagtccatccaatttctagtatttgtttattttgagacggagtctcactctgtcaccaggctggagtgcagtggtgcaatctggtctcaccacaacctctgcctcccgggttcaaggaattcccctgcctcagcctcccaagtagctaggactacagttaacactgttgaccatactatccgtttgtaatttttcttcctttggcttcatgatgccactctattctaatttgccttctatttctatgaccattggtaattttttctttgcaggtccatcctcctccaccctatcattatgtactagatgtcaagacctagttcattaccaatcatcttctactctactatctctcaccagaaaacacatcagtcatcatgccttgaattgcaatctatttatcaatgattctgatatgtatatctctaattcaggcacttgttctgaattccacagctatataaccatctgcctattggatgtctccacttgcatgctgcaaaatctccttaaacattatatgccaaggtttaaagtttgatcttctccctcaaactagtactctatcagtattccccagatcagtaattagcatcaccatccctcatatttgttatcttcatctccgctatggactgaattttgtgccccacaaaagttcgtatgttgaagcctaattcccaatgtgatgatattaaaagatggggcatttgggaggtaattaggtcaagagggtagagccctcatgaaatgagtccccttaaaatgatctgaagagatcagtgttcttttccaccgtgtgagggcacagtgagagagcaccaagtatgaaccaggaagcctgcccttaaaagacactaaatctgctagttacttgatattaaacttcccaaactccagaaatgggagacataaatttctgtggtttataagctacccagtttatggtattttgttacagcaaaccaactaaaaccctctctcttccttcccatgtttaatgtattgcaaagtctaatctgtcacacatacattctctgtctcctgaatatgtatgcttcttcctgtctccatagccagaacccaaatctgtgttgccattaaatgtgaccaaaaataccgcaatagcttttcacttggcctctgggcagtatttatggaactctctcttttatgtactactggaaaaattatcatttctatcttttttaattgacgcataatagatgtacttagattgggggtacatgtgataatttaacatatccgtataatttgtaaagatcgcatcagtgtacttgggatatccataatcttaaatatttgtctatgctagatacattcaaattattctcttctagctactttgaaatatacggtagtaaaaacatatctgattatgttaccttcattcgtaaaaccactcaaagactttctcatttttcttagaataaagaacaaaatttcaacatgatcctttataatctggccttcatagacctcttaactgtatattctactttgtcttttattcaagtacttgtagaaacaaatttcgcttcatattttctaaagtaattcagagctattctttattcttgttcctcctccaatggaataaaatccttcactgactcttccataaatattttgaaaactgggttgttaatataatgcatttgggccactttggtgaaatttatttgtctgactcaattatacatcaaataccctctgactcataaatatgagataggaatatccaccagtcactttcaaattcacgctttaaacttaatctctctagtctcaccctcatttgatttagactatctctaagaaagattgctcacttctacttagaggtccctgaaactcaaacgtgcctcaaggtactaggctggcatgacagctgaaagaaatctgctgaagcctatgttggagaaagatttctactaggcgttgaattgacattgctcttgtttgcacactgtaggggctcagaaaacgataccccaaagtatggcactttggcatgctgaaactttgaactaaagaacactggaaggcctcaaaagcagcctcaaaaccaaggtccctctgaccttctcctcccctcctgtctttaactccacattcttccctgaagtgagtcatagtaaccagaattcttcttcttcaaggtaggtcatagaaaccaaaaaccctctcctccaaagccaaccataaaagccagaattataactctgtattttgcccacctttctctctattagctagccataaaaaattctctgacatacttttgtttgatagtagatcataagaccctcattcaagtggggtcctaccccatgtgtaggaggaaggaattctacacagacaggcctggctggttgtccctagtctattactatcagatcattccctttttgtccaatcacattcctacatggctgtctactctttatcaactctaagcataaaaacagttttcctttgggtcattgggtcttcatttttgaaggctcccatgtcacctaaaacttttattagataaatatctcatgcttttctcttgttaacctatcttttgttataggaatgtctgctatgacctgtataaggaggaaggaaagggatcacagcctttctgctcctataacatgcatgttgatgtaactgttataccaccacctccaattcactgcagaaaaaagaaacaaagttgtttgtttttagtttgaaagtaaataattttcattccaaaagaaatcttttttttttttttttttgagacggagtcttgctctgtcacccagcctggagtgcagtggcgcgatctcggctcactgcaagctccgcctcccaggttcacgccattctcctgcctcagcctcccgagtagctgggaccacaggcgcccgccaccacgcccggctaattttttttgtatttttagtagagatgtggtttcaccgtgttagccaggatggtctcgatctcctgacctctagatccgcccgcctcggcctcccaaagtgctgggattacaggcgtgagccaccgcgcccggccccagaagaaatcttgtaacacttttagaggtgtattttcctgaaaaaggcaaaattgtatgtttccttttaaaacggtcaaatgtctcctttttttccccttcataaagcatatactaagtgcttactatgtgccagacatgctattaactccataaagaacagagacgagaatgcattagtccacattatcaagtaatttggtttagtgaagcatttgtttgacaagataaaaatggtttagacacagaactggggctcagctcacactggtctttttaagaggataatcaaaaaacaccttctctgtaaattaggattaaatcagcttctagcctagaggctctgccaagtatattggttatctccacacaaagaaggctttgtggagtcaacaccatggtaactgtctgtttgcttctctgtctgtgaagattttaagggaggcctggacaccagttggcacgtagttctgataattcaaatcaattcaaacaacaggatgtgaaattctacagaaaggtctttcctcattcaattttttgtctgactttataaatttggaaaggggtcacatacagtgcgtgaacttcccttttatacaaagatcgtatggagagtgattacgctcgttttttgatgtacagatttttaaaaaggcaatttcaaattttactagggcagtggtgaggagagcgttttgtctaaggaaaataacctattcataagcacagaggttaatgttatacttcttttctaaaatggaacaaagaaacatattaatgagtttggactcttctcacctgttggagttcttccctttcatttctatcattattgtgatatcttgatttcatgggaaacaggtggacactgaacccaattcttacacaattcaagctctgagctattcctaacctaatcttaatatttattttatgttgcttccatttggacttcttccttcaaacatctctgatttccttgctaaaactctttttgtccacacataatgtgcagtcagcctacactctaatacttaacatgtaccaccatctcttagagttctgggagttaactgtcagctactagcattgttttctctccaatattctgccagtggatagcctcatctctttatgccagcaatgaggatggaagggtgaagaggaagcagaggcagggtttcaaggcctcccatgtactctccctgagtgccaatggcctacatccaacgcttagttttaggttcagtgacattttcaatgcacaatgaactcagtctccttcccggatcctactcagaccctggcttccaagaagcaattgcacgtttattttattccttatcaatttagcaactatcgcttcatcactttttgtggtttgtcgtgtagttttcatgtatttcactgctactagatattcctcagatatctttgctgagatgcatggcaaatgaacagacacctctgatttaaatgtcttcatgctttaaattgggtgctatctactcttcccagtgctttgcagatggcattttctatcatactttgcactaagtgagcctgggtatttaattacgaacgaaatatatcattcagatgcaactcagttaccttctttaaaaccctcaaggaaaacactgaagacttattttcaatgccatattcaacgttggattctgtacatgtatttttgcttcttcataaaattactcgtttctaataattcttttttccccactttaacaactcacataaaaccattgctaatgaacttatgtatcataagttgctcataatgtgtccctacacctttggaatcagtccactaatatattccttagtgcttaacttactttcctcatatacttaactctgtacttaacgtacttccgaatgttatcagactctatcccttaaatgcagtctaactttacctagcttaaaatctcctttagctaataaaaaaataacttctcattctctgttcacaaaatgattatttctataattattgatgaatattctgtcctctattcttcaagtatatcttaaaacctcaatttgttattatttatggttagcagtgaagcgacaatttttttctcctttacaaatatactcatcagaaacccctgaaattaaaacttgtaaagtcccatcatacagggcaagtaagtctttgatttttttttttcttggcaaaagtgtattactacaccaagacaatttttcaaaaagaccttccattttttggaagtttcaaaatatcaaaagcctggggcatatataccaaatattcagagagtgacaatttttctcagtattatattgtacaaacagactcagcctcatccagttgaatttcccataaaaatgatgtaaattaggttaattacatcccatatggtaaatactgagagatacctgtgtatataaatgtttaaaataaattcaaaggcaaaaacacatacaaacatctcaaagaactagagaaatgtttgccatttaagaagttgtcaattttgaattgtcaatagtaaaacattacatgaattagtgctatataactgtgctaattatgtcagaagagcctcctgatgggcactgtgttctgttaattttctttacagtgactgccacataacctattaaactaagatgacacatttacataaattttaattcagtcactttcaatatacaagttgcaactcatcattcccaaatgtgtaaactttgagagtggaagtcctccaagctcccagacttaactaatttgattagtgaactaggtttatgaatggccattttacatatttaaacatcttagcatgtagaatttcataaaaacttataagcctcatccttagaaacctgaaaggaaaatgctgatgcctgtgaaatacgttaaccattgcagggtcccagggctctaggcctagaccagataatttatgaaaccaattcttaatgaacattttaattagctaggaagcaagttttaacattaataggaacaaaactataattattctttgttggtattaaagaagaaataattttggaggtaagattttccaactttgctgtatttttaaaaatcacctttcttcttcagagttttccgaagtgagaagacattttaattccatattactatacaggcactttcctgaccctaaatccccaaccatttgaagatgacctactattcatcttccaaggctcagttcaagatgcacatcatctgtgaaggttttcttgatcaacctctctctactcttcccctttcaactttccttctgggaaaacttgtccctctctgcttgtttccacatggcatttgctttaaaaaaaaatcgagtaatagaatacaaattcaatttgcatcaaatagatcttataaaaatatcaaatgaaattcagtataaatcctattagttctaaaaatatttttaggactttgagatgcattgactacatggcaattattatatttttggaattacagaatattattaaaggggaaatcctatttaaccaaaagaaaacaagctaatatttagataaatagttccctctccaaatcaagatagtttgtatacacacacacaacacatacacgtttgtatagtgtaagtgtgtctccctctgtggaaggggggaagatagggccacatgattgtcttgtattttgtaatatgtgtgatacgtgtgtgtttgtgtgtatgtttaagttgctttaaatgtaaagtaaatgtgcatttaaaaatatactgagctgagggccaggcgtggcggctcatgcctgtaattccagcactttgagaggccgaggcgggcagttcacttgaggtcaggagttcaggaccaacctggccaccatgacgaaaccccgtctctactaaaaatacaaaaattagccagctgtggtggtgggcacctgtaatcccagctactcgggaggctgaggcaggagaattgcttgaaccagggaggcagaagttgcagtgagccaagattgtgccactacattccagcctgggcaacagaacgagactcagtctcaaaaaagaaaaaaaaataacatagctatatatgtgtgtgtaaatcaggcaccacaggttttaatccctaatttttatctttctggtattttcttgggtaaattaatttcttcgatcttcagcgacttcttgctttaaattgtaaaaatttaaaagctgttatcaaactggtcctgaagtaaaaacatactgtaaaccaaaaataaaaggctaactccccctccaaagggacttcctcctcagccagggctcttaaaatttaacctgaaagactggttcaggccaagaagggaagtgggggtcagacatgcctcattatacctctctgacacttacatcaacacagactttaagtctgataagaagcactctacagcctcttctctctgaagcctgctagctaaaagcttcatctacatgataaaactttggtatccacaatgtcttatctcaacccaaacattcctttctattgatcccaggtctttagacaaactcaaccaattgtcaaccagaaaatgtttaaatttacctacagcctggaagcccccacccccacccagttgtcctgcctttctggaccaaaccaatgtatttcttttttttttttttttttttaattttatttttttcagacggagtctcgctctgttgcccaagctggagtgcagtgacacaatcttggctcactgcaacctccgcctcccaggttcacaccattctcctgcctcagcctcccgagtagctgggactacaggcgcctgccgccacgtctggctaattttttttccctatttttcatagagacggggtttcactgtttcagccaggatggtctcgatctcctgaccttgtgatccgcccgactcagcctcccaaagtgctgggattacaggtgtgagccaccgcgccaggtcaaaccaatgtatttcttaaatgtacttgattgatgtctcatgcctccctaaaatgtgtaaaaccaagctgcaccccaaccaccttgggcacatgtcgtcaggacttcctgaggctgtgtcacaggcgcgcgaattccaccttggcaaaaatcaactttttttttttttttttttttttttttttttttttttgagacaaagtctcattctatcacccaggctggagtgcagtggcacaatctcactgcaacccccgcctcctggggacaagcaattctcgtgcctcagcctcccgagtacctaggattaggcaaaatcaactttctaaattaactgagacctgtctcagattttctgggtctacaatacaaatgctttttaaaaattacttgtaaatatgtttacttacctctctaattaaagaggttttgacccaagatacaaaaactgagatcagctttgcttatattgtggctttcatattccaattacattagtctattcatctagcaatcaaattaaataaaatctaaagatgttataattcccagttataataaaaagcctataaactcttcagtggtttacacagcacctggaacaatgtgacagatgacagaggactctgtcttcagttagtggaaactgctatattaacattcctatcaaaaatctatttttccttatatttgcatggtctcaaatgtatttctagttttatatgtgtaattttaagcacatcactcataaaataatatgtttcagtacagtaaaatttaatgatttcagattgcactgaaaggcatctttaaaagatactaaaaaatcaatttctgtggcgtttaccttgtcctaaaatatgcctatttaacatgtgcctcaaaagctgaattctagtccaagcacaaaatattgtccttaaaattgtacatcttctttattatcaattatggcataccgaattatatacttagtatgtttaaaaattctgctttttaaaatacatgcccttgcatacaaattgaatgatttaatgttttaagctattaatgccaaaaatgtctgagttatttggtattgatattcatcttggcacccatagaatcgttgattgcagtgaagagaataaaactgctgtaaaatattgcttctctgcacaaagtaaaacttacctaaaatattttgacgtctggtaggtagaaatgatgttaaaataatcttcctaccttaatttggtattaaatcttaatcatttcaaaattcattggtaatatttatttctaaagtgtgacatgattgaacagatgtcacatttataagttttgtttaaatatctttgagagaaacaaccttaaaaattaaaaggtaagaaacccccacaaattctaaaatgtcagatactgctacattagaggaattagttataaagccaaggagtgtgaaaacacgtgggcaaaaactgcatgacccagaggatgggaaataaaatgctgctaagccacagatgcctaaagcctatttttcattttcaataaattgaaagtccctttgaaacacacttctgtgcaagaaaatcaccttaacacaggttaatagaaatattctcttaaatgatagatgaaatcctgtcagagtaataaatctatgatcatacaatataatatactcaagttgaaaatcctgagtcatatattttaaaatcaaatgtaaagtttatttaaaatgatgaaacccaaaagctgcctatgtccttatgataaataaatgtgggtcactagagggcgcacattccctttcagagcttgtcttcaatttggcttctttcgttttcttatctgcataacgaaaatatggtgacaaatgaaattttcatggaagttttacttacacagaaatataaaatgtccaaagatatagataaaatagtgtacaaataatatgtaagtaagacactctcagatgcactgttaaaatgccttcagccattttgaggtacacacaaaagtaccttgaagccataatacatagaatcccttgagaaaatatgtccacagtttggagagtcatgcttagttcaaataatttagtaaaattttctggattatgtagcaagtagttttccttcccaagttcattgattttaactaatttttgaatgtttagttaaatatgtggacactcgtactctaaaaatctgcttaaaattatactcctaaatcacctaaagttttttaaaatgccaaactttcattcaaatttaaagaacagaaaagagacatatatatcattttaagcatcttaatcaggtcacaggctttcaaaaagaaaacttaatcgctcaagaaaccttgtatgttatctgtaatagcttttatttttgcagattgatcatgaatagaaaagttgaagatcttcatttagtttcaatacacagtgaagcactgagtcaagactcaagaacaggtctgtctgaatccaaagatttctacaacactacatttttcttttgttccaaataaacgagaaacccatcttaaaaaaaaaataaggataagtcaatatagaattactgttcattgctacacagtacagtaatttagtggttttgactacgctatcttggattatatgagaatttgattgaagtctctaatatcaggatattaattctgaaatttttcattaaaatatgatccttagttgtatactttgtaccctaatggcaatataaaataatttatttcccaatttattattaccttggaatttcccttaatttcctaaaatcctcaactttctaatctgatgatacaatttctcacatcagagaaaatattaagcatagatgaaaaaagttactacttattatataatgtggttaagaccatggtgagctccaaaagtcttgcacttggaaaaaaaagttcaattatatggaaattccacttatttttgatgctgaaaaagacatctaaattttaaagaaatcttttcagtgaaaaaggtctctgtatttaaagataatcaagtgttgccatgggacactagagtcaatgatacttcagaatgtagaacagacataatctagaataagtgcagcttccatagactttggcaaattcttaaggagtcccagtcaagcattttatttcagctaaataatttgatgaaatcacctttaacttattacaacatagcaaggcgaggaatttccgaaggcaacaccctaagctaggctgtctgggttcaaatcctagctgcgatgcttcctgtaaactatgtgaccatgagcaagtcacttgaaatttctatgacacattgttatcattggcaaagagtgacaataataaaacttacttcgtaatgctattttaagtgtgaaatacattaatatgtagcaaatacttggtagaagccatatacatattagctattgttattaatatcttccatgatccttttttaactggctttaagccctatgccatttctcactttctcacgtgtgagagtagtcatatttgttttagtgtcttcttaatgactgataaagtaaaagccacaattggaataacaagaataaaaactgcaaacacagctataacaaagacaatgaaacatataaacaaaaatcaacagcaaaatagtctcattttacccattagtgccggaatccccaaagtatgttctatgggacaaatatggtctgccatctaatttggtaaataaaattttactggaactcagtcatgctcattcatttatacattgtttatggctgctttctagctatagcagcagagttgagtagttttaaaataaattttatgatacacaaaacctaaaatatttactctctggccctttagagaaaacttttctttcccccttcccagtctatgaaaccaaggtaagatggcctctctctcccaactctcaagtgagatcaaaatgatatggttcacagtagccatatcatatttctctctctcaaaaatatgcaatggctccccatgaccagaaggtttaagtctacatgccttaatcttttattgaatacctttagttattatgaactcaacctaccttttcaacctcattccttacttctaaacttcctttacttcatacttctgctggaggcaaacaagaatacttaatcccatgtaagttttgttcgcatacaggctttcccctgcaatgaattgtcactttcctcatcttgagcccaatgcttccctactctttaattatccagtcagatgctaattttcccataagtcttccatgcctctcaagcaggaagtgaacttttcttccttaaaacttttctaacattttattagtacttcttcatgacagtttatgctgggtgcaagcttcctgagggaaagcttagatttacagttaaagtaactggagtgttttacataccatagcaatccattagatattagttgagtgaataggaaaattagcatgaaaactaatgttgctgtctcttctttcttgaaatgatgtggactcataatgactacagaagtgttcaaagaaacccaccatgcattggatgatgacttggaccctgtgggaggcaatttaaactttaaactctctcagtgtgaaaggtccttgagtttaagagaagtcaacatgcttgtgggtctttcaagtttaaataacttccaacccgggttccaaaaggatctagtgcaatgtggaaagccatttcaatctgacgtgtacttaatgccccactgccagcatcatgacctgtttcaatccatctactgtgttagtaagcatcactatgaactttagtcaaaacagaagtaatactcattgcttaacaaagccggtttttagtcagctagcacttacataacaaaataccatagactgggtggcttaaccaacagccacttatttctcgcagttctataggctacaattccaaaattaaggtaccagcaggatcagttcctggtgacagccttcttcctggcttgtagacagcctctggtatagtttggatattcgtcccttcccaaatcttatgctgaattgtaaactccagtgctggaaatggggcctggtggcaggtgtttggatcatgggagcggatccctcacggcttagtgctgtctttgcgatagtgagttctcctgagagaactcacttacaaatgtgtgccacctccccctgcactgtctcactctccttgtcccattcttccatgtgatgtgactgtttcccctttgccttccatcatgattgaaagcttcctgagacctccccagaagcagacgccaccatgcttcctctacagcttgcagaaccgtgagccagttaaatcaattttcatgtaagtcactcagttgcaggtatttctttataacagtgcaagaacagcctaagacaacctccttcttgctgtgtcctcccaaggcagggagaaagagccagcaagctctttgttgtgtcttcttataagggccctaatctcctcagaagagccctatcttcatgacctcatctaaatcaaattatcttccaaagtctccatttccaaattccatcacattggagattagagcttcaatataagaatttagggaggacacaattcaggccatcccagcctggcatcatttttatatctctgtggtagcataatatgtgttcatttgtaaagagacaggtttctgaccagggaagactttactaagaatactctcagaagatgtcagaataagaataatatataaatgtggtcatgggaagataccatccctgaattaataattggaaactcaactttctcctggggaaaggagacattgttttttaaatgtaaacgttcttcaagacaaacacatgtaatataatttccacagtgtgagggcaaacagggaaggccatatacattccatttcaggggtgacgaaatagattcttggggagattaagtggcttaagtcacatagtttatgagcagaagatgcacggccagaacccatctgtgcagtaatatgcccatctgctctcagatctattccccacatttcttctgtactttctgtattagagggatatacatttcccaacaccacttgccctcctaattgttcatttggaggcaatggcagaatattggaaggtgggaggaagagaaaagccaaggtcttttttcttctccaactaccttgggtggcatttctagagcagatgtatctctgctgtggcttctgttttctctggatagctagctccctcttcaacaatccaattttctgcctggcagtcctaactttagtttaatctctgttagaaagccccagcttctgagctctggtaatatcactttttctgtattgtttctccagctctagggatattagcagcttccttacgttactagtgctttgagttgcctctccatcccctgcgctgcgtctcagttttctactacctgcttagccaattccttatattacgtttcctctctttaaatcacagtgattttgtttttctgacaagactcgcacaaaacctggaaaatccctcatcaacatccaataaatatttattcaatacctactatgagctgacttctgctttatgcattataggtgtacagatgacaagaaatgatttcttccctcaaggcgtttactggagatacaggcatgcaaaaataaagtcattaccatacaatttggcaagtgttttaatagaagtgttaaaaaggctgagaagtggcctggcactgtggctcatgcctctaatcccagtactttgggaggccttagcagtcggatcatgaggtcaacagatcaagcccatcctagccaacacggtgaaaccccatctctactaaaaatacaaaaattagctgggcatggtggcccttgcctgtagtgccagctacttgggaggctgaggcaggacaatcgcttgaacccacggggcagaggatgcagtaagctgagatcgcgccactgcactccagactggcaacagagtgagactccgtctccaaaaaaaaaaaaaaaaaaaaaaaacacacaaatggctgagaactgcctctgcaaggttagataaccagaaagacaaggtggttagtagcacggtggcaggtaacatgggaatgggaaaaagaaaggtatctaaagagaatcttaggcagagaaaacagtaggtacaaagaaacagaagcttaagaaagcacagagcatttggagatcaaagagtggttaatttaagctaaagcatagggcagtgcggaacaaagttcagactttagcagacagtgaactgtttgctattagtctgtaagaagaaaagagttttcaccagagtataaatcaactgagtcactgaacaaacgatttgatcttattttgcttttaattgccgaactttcttgacaaaggaaggagtacattgatttatattctggctcaagcttcttatctcaattgtggactggtactaaaaagtttgcagattatttggagtagcactggtattttttttaaaaaaggagcagaggagaagggagtgaagctggagaggtaggcagctaaagatcacaaaagaatttctacgccatgcatttcaagatttatgggcaggggaataatctaattaaaactgcattttaagatatccctcgggaggctgtaaaaagcatggataagagaggtgagatcagaggcagagaaatcagttaaaaatttcatacagaaaaatttcagttttaactagagtgaaggcagcaaggatgtagaaaaaaataacaaactaaagagaatttaacaggtacatttggagggatttagtgatgtggcagatatcaagaccactgtgaatggctgcacaggttgctcactgcacaagttcaggatgtaccattcttagagactatgatgtgaatgaccctctctagagttatacgatctaaactccaaaactatattttagattccagtcagaaatccaggaatacatagcctataagcatttgaattatacagggatgaacatcaggagagagggagaggtagaaatatcaatttgtgaatcaaaaatataggtgatgataaagattataaatgatatttccccaaaaaataaagcatcataagaagaaaataaaatcacaatttgagtcttatgtagactgacattaaagggcaggaatagaagacagggaagatatactctgaaagaaaacaggagagaacaatgtcccagaaactgcaggagagaaaaatttcaagaagggactaatcatttctgtcaagcacaagacaaaggtcaaaaagggaaaagaactgaagagtgacctttggagctggcaattaaggagctctctggcgaccttgctgagagcagtttcagtgctcgatgtagagtatgagagggtaaaggaaagaatcaggagtccgtaagggaatacagatagttcaggtcttctgattaaaaactgacttttatttgcactcaactatgcttctccttttagatgaataagtatgagtaccattttcttcactcaaaaaacgaacaaaattatatgtaacagctctgggaatgtgatcctgtcttctttcgtgttgatattcttttacgccttgcattctggaagaatacattttcacatagctactgtagccagacatccaaagatatagtatctcataggaccagttctcaatatagtgcatttctattcacagcttgaattgagcatctactacacagaagacatcacacaggtaacgaacaagaaatggatcctggcccagggaagctttaattctagtggatgaaacaagcatatggatagatcatttcatcataaagcagtaaggtgtcacaagatgcaacagtagcatcccttaacctgcccaggaatagatggcccctgtcaggcctctgagcccaagctaagccatcctttcccctatgacctgcacctttacgtccagatggcctgaagcaactgaagaatcacaaaagaagtgaaaatgcccggttgctgccttaactgatgacattccaccattgtgatttgtttttgccccaccttaaccgagcgattaaccttgtgaaattccttctcctggctcaaaacctcccccactgagcaccttgtgacccccgcccctgcccacaagagaaaaatcccctttgactgtaattttccactacccacccaaatcctataaaacggccccacccctatctcccttccgtgactctcttttcagactcagcctgcctgcacccaggtgaaatagacagccttgttgctcacacaaagcctgtttggtggtctcttcacacggacatacgtgaaagcccctttatgggggctgtcataaggaaagagaatcaggggtcagactgtaaatgacaagacactccagtgaactgatttccaaagtgtgggccctaaatcagtagcagcagaatcacgtgggaccttgttagaaattaaaattcttgggcaccactccacgcctattagaattagaaactctggtgactccgacgcatgctgaagcatgagaaccactgttgtcatgccagtgcgagggttctcaaattttatggtgtataagtatcaccgagagtgcttgtaaaatatttttgggcccaccagcagtgtttctgattcagcaggtttgggaagggccctccaaatctgcatttcaaagaaggtcccaggtgatgatactgtttcatgcactgcagtttgaatattactgttctaagtattctctgatcccatagcattctctagaattcacattactatattcttcaaaacactgctattgatttattcttgatgcataagacaacataatctcaagaacatttaatagatggttatctttttgaggatgtgaagatggtatgcaagatttctatttcttttttttttttttttaacaaaaaatagtgtctaaagcgaaatttgaatttatgaccaaggtcattttcctttaatacataaaaagtaacatgacattgcaactataacactagaatggatttaggagagtcagcaccagtccttattttgcaactgaaagcaagttatttaacctttctggacctcaattaacctgtaaacatgcataagtctagtctccttaggaaaaaaagaagcaaatcatctaaaatgttttgtttctatgggctgtgccaataggcaaaagtgtcattactgagtttaacatcccagatattttaggatcaatttatcatatagaacattaaaaaaaaaaagttcacggacacattaattatctaattaggtccttcaaataacttggtatattttgccatacaactttcagattttagtttagaaactgaagttataatcaatatctaaaacaaaaatgttttaggcatgagtctcacaaaactgcagagcggtcttatctgttatctattttctttccagagatgtgacacaatttaacttcatctggacagcagccataaaaagaaaatcaaacaaacaaaaaacagaaacaaactgaaaagtagaatatataataataattcaggtatgtagatcagtcaatttatcctcctatgtagttaggatgcaggaaatagccgagaaagcaagcttacattctgtctgcttaccctggagggaaaaaacagaccaggtgaactgaggcatttcaaaatgcctctacattatccttgaggacaaagatattcatttatgaacgctttacttgggggaaattatctttattaagatggcattcacttaaaaacaatttgccattcattctgcctggttgctacaaaagtataaattaaagctttttttaaaaatcccttaaaataactgctacatgattaggaagtaatctcctggataaataccaattaactagataatagatctagttttaccctaggctgagttccttactctgataattacctacgtgtacaataatatcactgaattgcaggaataatttgctattagaaataattatcttgtgacccaagatcatcagacacttttgcaaatctcagtgtaaagagaaaaatttatgcaataaatacaacatatgtagaaactgtataattatttaggaatcgactaaatgtaccttagatagttaagaaactatgtggtagaaagctgaattttaaatcccttaattgttttgggtaaataaggataccctaatgggtaaaattggaattattaaagatcatcaggatggtcacgtttattattaagaacaattccaggaagagctaggtagaatttttaaatgatattgaaatgtcaaattttagttactgcaattatttgaattatataccattcactctctcaacaaacatttattggttacttattgtatccacggtatttgctacaatggaatctaagtaaaacataaagaagtgtaataataggcttcctttgttttgacgggcaatgagaaattttatgtgagtggcatgaaggcatacaacaaaacgaatgtaatgtaatttactggctgaagtggaataatgattattgggaaggtagacataaaattagtggagaatgagaataatactgaatgccataggaagcacttgggttttattttggaggtatctggatttatgggaattcgcatgtctggagagacatcaaaaagcatcattttagatatattcattttagtaaatcaattagaaaggagggcagttctctccacagtgaggtatatggctcaggttatggacttggcaattcgaatgaacatgaaatgacggaaatgatggcacttgcccaataatacaatctaattataataaataaggaaaagaaagtagaagaaaaattcacagaactagagatgtcaggtggtaaattctgttttgaagaggaaaacaggaaggtaattttacatttcttaggtttgagataatgtttattatggaatttttccctgtcgataatagatgactaccatctccatcactacctccaccaccatcatcatcatctctactatcgttacctctcccaccatcacttctactcctcctacccaccacaatcttcctccatcttcatcatctctatggtctccaccaccaaataagaatcgaaccactgcatttattgaatgtttaccaccttaaaggcaatgtattaaatgcttatttaatcctcatgacagttgttttataaagtgagaatactggaatctgaggcacagataacaagtaatttgcctgcgctcataagctagtaattaaaacaggcaggtttcacaaataccacaggttcttacctataagtgagagataaacactgagtacacatggacacaaagaagggaataatagacactggggcctatttgagagtggaaggtgggaggcaggtgaggatgggaaaactacctatcagatattatgctgattacctgagagacaaaattatctgtacaccaaacagccacaacacgcaatttacccatgtaacaaacctacacgttaaccccttgaacctaaactaaaagttgggaaaaaaaaaaagggcagcattcaaacctcagtaattctgattccaaaagcaatgattttttccatatttgctacttctctagacacacaggcaatgaattataactaaaatatgtgtgcaatgtataagtaggtatggttaattggaaggaacaaatgtttgcatttgatgaacattgaggcagttgctggatgcacaagcggaaatagctttagagatataaagctttaatttgagggagagtgtcacatctggagctacatgatttgggagtcagtcacttagagccaggctcgaatcaatgagaggagataatccagataaagaagtcaaaaggccgggcatggtggctcatgcctgtaatcccagcactttgggaggctgaagtgggtggatcacgaggtcaggagctcaagaccagcctggccaagatggtgaaaccctgtctctactaaaaaatacaaaaaaaattagccggatgtggtggagggtgcctgtaattccagctactcgggaggttgaggcagagaattgcttgaaaccaggaggcggaggttgcagtaagctgagatcccgccactgcactccagcctgggtgacagagcaagacactgtctcaaaataaaagaagtcagaaaggcaaagagatggatctgtgtgatactcccataggaataaggcagaaggaataaaacaagtcaggtaaagagtcgtgggtgacaactggtagtgtgtcacagaagctggaagaggacatcatttaaataaaacactattcaacagatggtcaagacctcaatattcagtgaaatattagtgggcttcagatgatacaaaaacggggcactagctaatataaagcttatggttatatttgcatgatgcctctttaatcattacaatactttaacaagattccaccctgtagacaattatcaattaatgaatttgttcctaaatgtttgcctttttgctatcttcgttcagtctaaatttatcaatcaagtgtcgtatatagcgtgttcagataattttgccgtccaaatcaggacacacttgagagtgaaagttgatgctatatataattatgctgggacaacaggtgtaactgggatggcttcaggtaaatcaataggattaccttagtcatatatctatgaaaaagacattttactatacagcccaggttttgtagctacctcagttcaaatcctgtctgaggtacactgtagctgtgtataattttataaagtaattatagccatacctattttgggaggttactgggaaaaatacatgcgatgccaataaagcactgaatctactactgagcacataataaatcctcaatttatgttagcttttatttgaagaatctttctgtatgtgcccaatgggacttctcatttaggcacatacaaaaattgccgaaaacttatgatacaaacaaattttggagagaaggtatttcaccactagccactctttcctgaaaacaaaaagaagtcagaacacactttttttttttttccaacacaatccattctccaaacaggagccaataataagcttttgaagacagagattgacatgaatcagcttgctctgttaatttctgtattaggcaagtcctgaagacattaaaagtgttaggcaactaggtgtccctattactctgtttggagaactgttggagggttgttggaatgttgcaaagtatccataaatctgtatgtccactaagcgttgtctataaacacatgtttaatgtgacaacaaacaagttaatgtacatcttactaggaataataaaagaaattcatcaaaagcttcacggatttgtgccattatgcttttcactccatcaatttttgttagattttctattaccatcgtgagtagagtgcttggaagttcctgaaagttgttgccacaaaaagaatgctaatattcatagagtttgagagccatttgactggagcaagggtcgccaaactttttctgtgataggataggtaataaatattttaggctttgtggactatacagtttgtgttacaactattcaaactctgccgttgtaatgcgaaagtaatcataagtgataaataaatgagtttggctgtgttccactaaaacattatttataacactgaaatttgaattttatgtaattttgacatgtcataaaatattatttttcttttgattattttcaaccatttgaaaacgtaaaaacacttcttggctgatgagccataccaaactggcagcatgctaaatttggttagcaggtcttagtttggtgacccctggactagtggatttgcttagccaagctgacacaaccagggagaaaaggcccagtgatttactttggaattatcaaagtaggtcataagtcattagttaatagagaagtactaaacatcccaaataatatatttgaataacttctctagatttattttttttcttagaacatctgacatggtatttttagatgtgtgttcttttcaaacttctctaccctggtatacacaaattctaatgtcaagtgttccatgagtttctaaacatatgctgcttaaaaacatacggcagattttaacgttctttcttaatcttagaattacaataactggaatgaaagggaaattgtaccttttaaaataatttttatgccagctttgcactcataaaattttattgccatcattttaatatatccactgatttacataatacctaacttatctaaaatgcataattctgaatagtcacaaaaagatcagttaaaaattctaacaccttcaagataagactttataaatatcaaagaacaggaaatgtgttctgtaattactcctgatttaggatgcgcagactgagacatcatgttctcgtaaactaccaggatggatcccatctattataggtgtacttcttcatgaaaatgcactttccgttactggaaaaaaaagacatttaatgcaaaactagggactcaacaagcaggccctttataaggaagaaaaaaaaaaaagaaagaaagaaacttttaggattaaaatgctaccacagtagtttatcacctatagtttctatagtttcttctttcaccccagaaaacaccatttccattaagcatttactttctgttgcgatagtgatttcttgtgaaagttttaaaatgtacttcataatttttctcactacattaactgacattacaggtacccgaggattctggaaatattgctgaagtgaaaacaccaccaacaaaactgctgtaaatgagttttctccacttcatttgcagataaaagcttaagatgctctcaccttttcctaatttcagaatccacagtaatctgcctcttcttttggggaggtggtggtggaagttcctcttgagcatgctttaccaggatctgttcccttgtggtcaccgtagttactgtttccattacagttgtctgtgttagtgatggctgagtggtggtgacagcctgtgaaatctgtgagaagtattgaaacagaggtcagacattgctagaaagacttcagtaaagactgcttggagtggcaaaggaaaataatgagaaactgttcttgcttgttggtagattgaccttcagatcaaaatagcaccatattgaagccaaataaaattgttttatctgacttaagtttggttcactgaaatagcaagggaaagtaatctcaacatcgaaagtcaatttagcgccccttcaatatattggtcaaactgtaggaaataaggggtgggggcagaggagaaaaatgtagagtataattcattctgatagttaattctacatgctgtttaaaatgtttacattaatatgaatgttactaacgtacatcagtaccaattccattgcctagaacattttaaatgcttattaatagtttgtagaatgcatttttggttatcatacacattgattattttatgttatacatttttaaataaaattatttcaacttggtaatgaacgactctttaatcaaataagtgaaacagcttttaaaattacaataaaaggttaacataaagtatgtattagtccatatatatctttatgttgaatgttattcaaatgctaaaaaacacactactcttgtttgatttaaattagtgattatgttcaaatatttgagttcccatattcatcactggagacacttcttggtttagaatctcaattacctcctgttcatacttttggcagcgggccgggggcaacagttcatccatctttggaataatacattttgtgagccaagacatgagaggccatcacctcaatacatgggcattacgagatagacaagtcatataatggtgagacaatcattccttatcatattctccgtctcacagagctcctctcatgacgattgtaacgttacctcttgggatggtaatcattatccttctggcaatccaacttatatgcaaggtctgtttccaaggaagtcacaagaggcctgcattgaaactgcctctggttacaagcaaaggagcagggatctggctgggtcaagattcattttagcaattttcctgaatttgccaagaggtaagggaagggtttgtagtaatctccctgcctcatacacgaggactgattcctttcatgtgaggaaatgggaaaagcctcaggatcttcttatttcagcttccaaattggcaatgaacagtgaaggaataaaatcttttccatgatgtcttaagtaaaaattgctttgacatacatagcttaaaaaggctaccttttgttaaagacatatctttacctatgtgagggactgaaggatttccattttggtaggctaaaaggatactaagaattacagtttctacatttgccaagcacaggttttatcttctctaggatctccatagattcattatttagaatgaatcactgaacctcaaacaactttaattataagtctgttgacaagttatgtcaagatgaaagcagaaagcaacatagctctaaaaaaagcttaaaatataaactcaaacattgcacccaacacaaaatgaccattacgtgataaaattagttttatttctagtcaaaaagaaaatgtagtttttagtaggattccaagagcatttactttgtaatttgaatattttttaaccatgagaaaacttgctttgcaaagaaaatgcagtttttagtaggatcccaagataatttatttttttatttgaatatttttttaaccatgagcacactttctttgcatacagtggaggctagaagataatattttgcagattaagaaaatacctaattttaaacatacagaccagaatgcagagattctgaaaataccaagctaattcatgcagttatatccaatctcatagaacatttgtgctactaaaaatttgactcttaaattaatttctgtaatattaatattttcgtggtatctacttataaaattggatacatgtgcccatggagggtaaagggaaatgacaacatgatatactgtgaagcggcatttaaaaatatactcaaccttttaagaaagaaaaatgaatcatttttaataaaagagtagtaagacatgagtctgtaattgttctatataataatcactactacactgtaattgaaaaatactacttcatttccttcgggatggagaaataagaaaactgtgcattcaccctgtaaatatagggtagaactcattacatataacaaattaataatcactctcaaaacctacttcatacaatcagaataaaaaacaatcagtcatgtactaaatttccttatggcttatagttattgactataactattattgacacttaattatgtgttagaatcattaggaaatatagacaggagagggactacgaaggccatttaacatgacctcctgattattacagagctcactactccctgaaacagaaagctcctttcttagcatgcaagcaaactttccccattgggaaagatgttcttaacaaccagaggaatcctgcctgattaagacttcctcttgttaaaacttgttttgagttctgaatgaaagcagagtaaattgaatatcatttctacctgatattctaagatttgaaatctaataatcatgaccctgataaatatcattttcaaactctataatgccagttatttgctagaagtagatataacttgattcgtcatccaaaaccaatgtttcttggctttggacaccatagtcaatcaaagaattctaaaactgtgtaagttattcagcagctgaaccacaaggtttctataaaattctaatgtttattgaatatatattcactataggacattcagaaatgagtaaaatagaaactccatatttaggaaccttacggcaaaatagggacgatgataatcacacaaataattgtgaagatgaatgccacgtgaaaaataccagtatgcaaaataattacatacaccaaacatacagtaatcaagtaattttctctttaaatgttatgaaaacagatttctctcagctagcattttaacatttagatttaatttgatgctgaaggctagatataatatttatccttgtttatagggtctttctaacagtaacttttggaaacaacctcatgtcatagatgatggtttaagtacattatggtatatgaatgtggatggagtattatatttcaaatattttaatgtcattggaaaacgtttgctttacactattgagtaaacaatgctagacataaacattggttgatttttgacagagaaagtagagaaaatttctgttgcacagtgtatatttctgtattcctttagtttccaaagttcttctataagatattatctgcaaaatgttgcatttgtaagcaaagaaaaattttgaaagttttgccaaactgtttgttttaaatctatcatttctatttatatattaagatctatggaatcatactcctgtcactcaatgcattagaatgaggaaaacttcaagcatgataagaataacgtagtgccttcactaaaatgtttaatatggcagagtcaaaactagaatagaatatagtttgacctatattcaacaatctttgtatctagctaactatacttttacccagtcacctttcttcattttgattatgagtctatttaagactctaaaatgatatcatgaaaagaaaatacatttctttttaaaatactattcattttaactgcaagttaatttccctagtaaaaatgggaaatagtttagaaatacttgtctttacatttgggagctgattcctcttagagtggttataagtagaggcattggagccagtctccacaattattaaacaccagatccatagtttatacactgtgacatttggggctggttggttcttatctcaaatctatgcattattttcttcatctttaaagtaagagtaacacatttcttcacaggtgtgttacaagcaaggacagcttcatgggctggtaatttatgcagttgcccagggcccctgctcaggaggcttccatgcttgttttcaagctctgcttccactgtcttgaaattcttaggtcttgaacaggaagcccttgttttcagtttgcactgggcccacaaattatgtagccagtcctggttttgagaattaaatgatataatatctgaataaaataagtgctctataatggtaaatatcagcagtaaccactatcttttctaaacgctcagggaaatttgaagaatttttctatactcaaccttcttactcataagattacatatgttaaaaagatttaaactttaaaatttacattttctcattctgagaaaaattggaagagcatttgccagcatcctgatattattccagggtgtgcctcttcttgcagtaagattgtgttattttgataggcctgggaaaaacaaactatgctcaagaaatgaagttctttctttccatcttctcttccacttgtttaaaaaatgcacatttaaaaaaagaaacataagtacatcaaagcaaatttaaagaatacaaaaggacatacaataaaataaaatactttttttctaccactgtctccagtttattaggaatcactacaagtcatgtataacttaacaactgggacacattctgagaaattcatccttagacaattttgtccttgtacgaacgccgtggagtgtacttacacaaacctagatggtacagactactatacggccaacctatgtggtacagcttattgctcctagctacaaacctgtacagcatgtgactatactgaatagtgtaggcacaatggtaagtatttgtgtatccaaacatatcgaaaggtacaataaaaatatgatatagagagttgggcataaaacaatctttagaaaatttttttaaaacccacaaaattataccaacaacactcttggaccacagtgcaataaaaatagaaatcaatgttaagcaaattgctcaaaaccatacattaaaatggaaatcaaacaaactgctcctgaatgacctctgggtaaacaataaaattaaggcagaaatcaagaaattatttgaaactaatgaaaatttaaaaagatgtaacataccagaatctctgggacacacacaaagcagcgttaagaggcaagcttatggcacgaaacacccatatcaaaaagttagaaggatctctaattacaaaacgaacatcacaaggaacgagaaacaatagcaaactaaccccaaagctagaagacaggaaataaccaaaatcggagctgaactgaaggaaaatgagatgcaaaaaagcacagaaaaggtcaatgaatctaggagctgtttctttgaaataattaataataaagatagaccactacctagaataataaagaaaaaaagagagaagactcaaataaacacaataaaaaatgacaaaggggatgttaccattgaccccacagaaatagagaaaacccttagagactattcataatgaacacccctatgcacacaagctagaaaacctagaagcaatggataaattgctagaaacttacaactttccaagtttgaaccaggaagaaatggaatcattgaacagaccaataatgagttccgaaattaaattaggaacaaaaagcccaccaaccagaaaaagcccaggaccagacagattcacacctgaatactaacagatatagaaggaaaagctggtatcattcctatgaaaccactcccaaaaattgaggagcggctccttcctaactcattctatgagggaagcattgtcctgataccaaaacctggcagacacacaacaaccaaaaaagaaaacttcaggccaatgtccctaatgaacatagatgcaaaaatagtcaacagaataccagcaaacccaatccagcagcacatcaaaaagctaatccaccatgatcaaggagcttctatcccagggttgcgaggttgattcaacatacacaagtcaataaatgtgattcaccacataaacagaacaaaaaatcaaaaaccacatgatcatttcagtagatatagaaaaggcatcctataaaattcaacaccctttcatgttaaaaatcctcgacaaactaggcactgaaggaacatatttcaaagtaattagaaccatctttaaaaagtccacagccaacattatactgaatgtgcaaaagccagaagcattgtgcttgaaaactggcataagacaagggggccctctcttacaaatctcattgaacatagtactagaaatcctagccaaagcaatcaggaaagagaaataaaggcaatccaaataggaagagaggaagtcaaattatccctgtttgcagacgatgaggttctatactttggccatagtctctgcccaaaagctcattgatctgatacacaacctcagcaaagtttcagcatccaaaatcaatgtataaatatcactagtgttcctacacaccaacaacatttaagctaaggccaaatgaagaacacagtcccattcataattgtcaaaaagaaataagatacctaggaatacagctaagcaaggaggtgaaacactgctaaactgagaattacaaaatattgctcaagtaactcagagataacacacaaaaaatggaaaaatattctatgctcatggaagaatcaatattgacagaatggccataatgcctaaagcactttttaattcaatgctattcccaaaaaactaccaataacattcttcactgaataagaaaaagactatttaaaaattcagttggagccactaaaagagccagaatagccaaggtaatcctaagcaaaaagaaaaaagctggaaccatcccattgcctgactgcaaactatactacaaggatatagtaaccaaaacagcatggtacaaaaaacagacacataaaccaatggaaaagaatagagagtcgagaaataaggctgcacacctacaaccatctgttcttcaatgaaatcaacaaaaacaagcaatgggaaaaggactgcctattcattggaccccttccttacaccatatacaaaaattaacccgaggtggattaaagacttaaatctaaaaccaacaactataaaaacctaagaagataacccaggtaatgccactctggacattgaaactgcaaagacttcataacaaagacaccaaaaacaattgaaacaaaaacaaaaattgaaaactgggacctaattaaactaaagaacttctacacaacaaaagaaactatcaacagagtaaacagacaacctgcagaatgggagaaaaattttgcaaactttccatctgacaagggtctaatatctggaatctacaaggaacttaaatttacaagcaaaaaccaaacatcaccattaaaaagtgggcaaaggacatgaaccctttccagaaaaagacatacatacagaaaacattcatatgaaaaaatgctgaacatcaataatcattagagaagtgcagatcaaaaccacaataagataccatttgacaccagtgagaatggctattattaagaagtcaaaaaatcacagatgctggcaaggttgcacagaaaagggaacgtttattgcactgctgatattagtgtaaattagttcagccaccgtggaaagcagtttggtgatttcccaaacaacgaaaaccagaattaccattcgacccagcaataacaattattgggtataccaagaagaatataaatccctcaaccctaaagacacatgcacatgtatgttttattgaagcattattcacaatagcaaacacatggaatcagcctaaatgcccatcagtggtagactggataaggaaaatgtggtacatatacactgtggaattctatgcagccatgaaaaaagagattgtgttctttgcagcaaacatggatggagctggaggccattatcctaagcaaactaacacaataacacaaaatatcacattttctcacttctaagtgggagataaacattgagaacacacggactcaaagaaggggacaacagacacggtggtctatgtgaggctggagggtaagaggagggtgaggattaaaaaaactacttattgggtactatgcttattacctgggtgatgaaataatctgtacaacaaacccctgtgacatgcaatttatctatatgacaaaccaccacatgtacctctgaagcaaaaataaaagtaaaaaataatatagtataataatattatgagaccactgtcatatatgtggttcattgttgactgaaatgttgttatgcagcatatgactgtagttgcaattacgaactattcagctattctttaattttaaattcattttgtttatgctgttattttatgatatggtttggctctctgtccccacccaaatcctcatgttgaattctgtcttcagtgttggaggaagggcctggtgggaggggactgaatcatgggtgtggacctcccccttgctgctctcctgataagagttctcatgagatttgtttgtttgaaagtgtgtggcaacccttgccagatcgtggccagtctgcttctttaagtgggaccctgatccatcctcctcactgggtgggacctccctgagggggcttcagccattccacccaggattcaatggatagagctctgatctctccctgggacagagcttctgggaggaagaccagctgccacctctgcagttctttgaaactaatgagaacaaagagacaatttatcagaatctctgggacgcagctaaagcagtgttaagagggaaatttatagcactaaatgctcacatcaaatagctagaaagatcttaacagcctaacatctcaaataaaaaaactagcaaaccaagagcaaacaaacaagaaataaccaagatcagagctgaactgaaggagataaagacatgaaaaaccctccaaaaaactaaatgaatccaggagctggtttttggaaaaaaataaaaataaaaaaggtagacttctagttagactaataaggaagaaaagagagaagaatcaaataaacacaatgaaaaatttgaagaggaatatcaccaataattctacagaaatacaaacaaccatcagggaatactataaacacctctatgcacataaactagaaaacctagaggaaatggataaattattgaacacatttctcccctctaagactgaaccataaaggaaatgaattgctgaatagatcaataatgcgttctgaaattgaggcaataataaatatcccaccaaccaacaaaagcccaggtccagatggaatcatagctgaattctactagcggtacaaagaagagctggtatcatttccactgaaactattccaaaaaaattgaaaagaagggatttctcccaaacttatattatgaggtcagcatcaccctgatgccaaaacctgggagggagggagggagggagggagggggagggagagagagagagagagagagagagagagagagagagagaaggaaagaagaaagaaagaaagaaagaaagaaagaaagaaagaaagaaagaaagaaagaaagaaagaaagagagagagagggagagagaaagaaagagagagagagagagagaaagaaagagagaaagaaagaaaagcaaacttcaggctaatatcattgatgaacactgatgcaacaattctcaataccagcaaaccaaatccagtagcatatcaaaaagcttatccaccacaatcaagtttgcttcatccctagcatgcaaggttagtttaacacatgcaaatcaatacatgtgattcatcacataaacagaactaaagacaaaaaccacatgactatctcaatagacaaccaaaaggtatttaataaaattcaacatcccttcatgttaaaaattctcaataaactaggtatcgaaggaacatacctcaaaataataagagccataaattataaacccacatccaaatgggcaaaagctagaagcattccccctgaaaactggcccaagataaggatgccatctctcaccactccttttcaacatagtattggaagttctgaccagggcaatcagggaagagaaagaaataaagggtattcacataggaagagaggaagtcaaattatttttgtattcagatgacatgaacctatatccagaaaacccccattgtctcagcccaaaagctaagacttcaaactatactacaaggttacagtcaccagaaaagcagggtactggtacaagaacagacacatagaccaatgaaacagaatagagaactcagaaataagaccacgcacctacaaccatctgatcttcgacaaacctgaaaaaacaagcaatggggaaaggactgcctatttaatacatagtgctgggatagtcctatgcagaaaattgaaagtggacttcttccttacaatctatacaaaaattaactcaagatggattaaagacttaaatgcaaaaccccaaacaataaaaaccttagaagaaaacctaggtaataagattcaggacataggcatgggcaaaggtttcatgaggaaaatggcaaaagcaactgcaacaaaagcaaaaactgacaaaggggatctaattaaactaaagaacttctgcacagcaaaataaactaccgtcagagtaaataaacagcctacagaatgggagaaaagttttgccatctatccatctgacaatggtccagagtctacaaggaacttaaacaaatttacaagaaaaaaacaaataacctcattaaaaagtgggcaaagcacataaacaaacacttctcaaaagaagacatacatgtgacctaaaacgatatgaaagaaaactcaacatcattgatcatgagagaaatgcacatcaaaaccacaatgagataacatctcacgccagtcagaatggttactattaaaaagtcaaagaacaatagatgctggtgaggttgtggagaaaagggaacacttttacactcttggtgggagtgtaaattagttcaacccttgtggaagacaatgcggagatttctcaaagacttagaggcagaaaaaccatttaagccagcaatcccattactgggtatatacccaaatataaatcattctattataaagatacatgcatgtgtatcattgcaacactatacacaatagcaaagacatggaatcaaccttaatgctcatcaatgatagacaagataaagaaaatgtggtacatttacaccaaggaatactataatgccacaaacacgaacgagtcaaacttcttttcttcataaatcactcagtttcaggtatgtctttatagcagtgtaagaacaggctaataaattttccttttatttttgactgatattcttaattgaaacttttaactttccatttaattatttacatattattgcctttgtaacttttttgttatgctgggataagagatttcaacttcttgccttttgagatattctagtatttgaatatttagatacttactagaaagattcaagctataaagtattagttactaatttagcataaaatctttattttgcaaatactaatacttgcaataacaggtaccagttatgaagctttctgcatgatccaggcattacaataagtgttttgaattgattatcttattcaaaagatctagaaaaactcccttgctatgttgtaaagctttaataaatggtagctattatgacctcacaatggccctaagagtaagtactaatattattcctattttatagatgaaagtgaccttgttgaggcagataaaactttttagtagcaaagcatagatataaatccaagtctgaatgttcattcatccaactcttatcagctatgctcacttgctcctacacttgtacacttttttgaatggtggtttccttttaaggggtgtgtatttgtatgcatacacacacatatataaattcagaatactgaaattgtaaacaatggcacatcataactattatataggaagaattactcaatgttaaatatgtttggctcttgacatgctatattgaaatctgtgcaaaattagtcaaaatacactacacacacacaatcaggttgacaactgtggatcaaggcttttcattgcgttgtctgtctatgtatatgtaaccctttggagtgatcaataagttttaatgggcatggaggaattgcacttctgcagtttaaaacatactgcataatcatagcaacagctttagataataattgatagccatgcttaaaaaccaactccacaggcatggtagcacaaggcacaaaaatctggtaaagatttgcatctctaagcaaaagaaaatatttatatgttgaactttgggagaatccttgggcaaaagatcagatggtcacaaaggaagctgagttactaatcacaaggatgtaaaatgctttatcttatgaagtatagaggacttcccatagctgaatgtagcatacaatgagtgccaaagttcaggacagtagcctggtaactaaaatttactattaattactgtaattaatttattattacaataatttaataataatttaatttatattaataattaatttattactgtaaggtaataaaatttcttgaataagtactgacattgaaatcatgagcaaaattattgtcaaatacttagaaggcatcataagtcatttgtttcttcgaaataaatattatatgataattaagaaggtttattctgtaaaactgtctgtccaatttaatgtattttgttcctcattttaaattgtctttagtacaaattgtatcagaaagaagagatgtatgttgtcttctggattcatattaaatacggaatttgagcaactgtgtgaattaactgcacctgcaaaaattgcaaagcaatgagatttaatttttctgatccatctggccttcctctacataccatctaacactgaagtaatgaaacacattctataattagggatggatattatcaagtataggcttaggaaaaagacttgtatttgtctttatgtgttatttcatttttttgtcaggagataataggcgtatcatacagatgctgagcattttgtctgtatggtattttaatgacatactcagtgaatacagtgtaataatttcataattaagtctcctttgaatagggataggatgttattatcattattttttagctgcctttccagtggcaaaagtaggaatcttcttcactaagtactccagagtttcacataaaagcaaagagaaacatatcaaagacatttagaactcgatggccactatagaaatctgcctagcttacctttcctttaaatttataaataaagaatgagagattccaagagttaactcagactgaatgtattaaattttttagtgcttacattttatattgttacagacaatgcatttacaaggtaaaacctattgcactgatatacaaggcccattctcaaatacctattatagttggagatagcaaaatgatacagttaatttccaaagttatttgagatgtaacttcaaattttcttttttttttttttttttttttttttttttgagacgaagtctcgctctgtcatcccggctggagtgcagtggcatgatctcggctcactgcaacctccacctcccgggttcaagcaattctcctgcctcagcctcccaagtagctgcaattacaagcgcctgccaccatgcctggctactttttttgtatttttagtaaagatggggtttcaccatgttgaccaggctggtttcaaactcctgacctcagatgatttgcctgccttgtcctcccaaagtactgggattacaagtgtgagccaccacactcggtcaacttcaaatttttctaataaaactttaacctgaggaattacccaaaacatgttctcaaatttaagggagttaattctatgaccttaagtaagaaggaaacacaaaataagtaaggtatttttattttaattccagattttaaaaaattattttcttttttaattggcatcaggcttactagtcgtggagagctttcaggaagcaatgaaaaggtcttttaaataaaaagccttagagtatttttaattaaacttactggccaaaaaagaagagaggcaaaccatttgcaactatatcccccttgtacaaagaggtctacaaaatgatgctctgagaatgggtacagccagaacgtgaacataaaatattttatgaagggttaaaatagaggatctttaaagaatgagaattaactcagaaaagaagaacatgtaaagaaattttcatcttggtacattggcatatttctatttgcattttgggtataataaaaagcactggcttatcatttacagctatgttttatattactatttgataggagttttaaatctcccatcaggtgcttgcttcggcagcacacataataaatctctcatcaggatatagatgatatagaaggtacacataattatataataatcattttctctttttgggcatccttgaatgtaggcacaaacatatacagcataaacatgaactgccatgtacaagaagaggcaaattctgagcatatgtattttatcttaaagaggtgctcacagttgagaatgttgcaaaaattgttgttagcaatatagcaaaatattcacaaaatgggaatgagatatttgaaccttaataagtcatacaactttccttattcctgagaaagaagacaatttattctactaaaaatccacaaaactacaaaacctttagactcgcttgaaaaaaaaaatatatatatatatgcttacaccaaagcacctggtatatactacttaatataaattacatattaaatacagtaattacaatttatggcgtaatatgataattacaattagcataccaaattgtaaagcatatgactaatataccctttcaacagcacatgtgatttcagtcaaatgaggaaagtaatgcttcaaatcacatacattatattttaaaatattaattataataaatttcttactatcacatttatttttttaagttccagggtacacgtattggatgtgtaggtttgttatggaggtaaatgtgtgccacggtggtatggtgcacctacagacccattaggtagatattgagcccagcatccgttagctatttttcctgatgctctcctcctctcccagcaacaggccccagtgtgtgttgttctcttccctgtgcccatgtgttcccattgttcagctcctacttataagtgagaacatgcagtgtttggttttctgttcccgcattagtttgctgagaataacagcttccagctacatccatgtctctgcaaaggacatactctcattcctttttatggctgcatactattccatggtgtatatgtatcacattttctttatccagtctatcattgatgggcatttgggttgattctatgtctttgctattgtgaatagtgctgcaattaacatacaaatgcatgtatctttataataggatgatttatattcctttgggtatatatccagtaacggccttgctgggtatttctggttctagttctttgaggaaccaccacactgtcttccacaatggataaactaatttacattcccaccaacagtgtaaaagcattcccatttctctgaaaccatgccagcgtctgttgtatcttgactttttaaaaatcaccattctgtctggcgtgagatggtgtgctgaggctaatatggatgaattgagagaagtaggcttcaaaggtggataataacaaacttccctgagctagaggagaatgttctaacccaatgcaaacaagctaacaaccacgataaaacgtaacaggagcggataaccagaataaccagtttacagaggaacatgaatgacctgatagagctgagaaacgcaatacgacaactccacaatgaaatcacattgtcaatacctgaatagaccaagcagaggaaagaatctcagagcttgaagactatcttgctgaaataagacaggcagaaaagattagagaaaaagaaaagaataaaaatgaatgtacaaaacgtctgacaaatgtgggattatgtaaattctgaagcaaagactgtttggggaacctgaaagagacggggagaacggaaccaagttggaaatcacacttcaggatatcatccaggagaacttctccaatctagaaagccagccaaacattcaaattcaggaaatacaagatactcactgagcagaagccagcccaacattcaaattcagggaatgcaagatactgagcagaccaaccccaacatacgtaatcatacaattctccaggtttaaatgaaagaaaaaatgttaaggacagccagagagaaaggccaggttacctacaaagggaagcccatcagggtaacagcagatctctcagcagaaaccctataagccagtagagattgggggctaatattcaacaccgtgaaagaaaagaatttccaaggcagaatttcatatccagacaaagtaagcttcataagtgaaggaagaataaaatcttttccagacaagcaaatgttgatggaattcgtcactatcgtatttcataattatgatcaagataaaatatatatcgatcagggccaaggcaattagaaaaaactgcacaaattacaagtatgtttataaaaaattacagggaatcatgatcatttgagtttttaaagaagtcaatccagggtatatttgccctcttttctcattgtaagcctccagatagcaagagttattatctctccaacatttagaaaaaaagtattttctatcttcttaggctaccttctaatcaacttaaataccctcagcttgtgtccaggtattattcaagtcaaatctgagtttgaaatgcaagagagcagtcctcctagctgattattttttcacgttttgatctcttgccatgcaactgcttcaaaaggtcaaaaatgcctcaaagctctgacctgaacagcaatcatacgcgcaagcagtgttctttatatgagtacaactgggtgccttgtcatctcaatcacgatttccacaccctgcctcacaataggttttaaccattatgagaactttgctcattctttatactaattatttaaaagaatttttgaaacaattgagtatatcatgtgagtagtcattaatgaaactcatttttctcccacaatcattatagaaaatgtacatacaagtgagctttgttcttcaaagtcacaaccttacagctcatattcttggaattctccttatgtaattttaatcaaggtcaatttaacatggataaaagaaaatcagttgctcttatatgatactatttcgctgttgtctctgtttacctccttttaatttctcttttcctgagtagctccatttctaccttcctgtgagctcaaaaacagccagcaaagatttggatcaatcccatgacagcataatttttggaaaggcaatgagagaaaactgaaacataagcttaagaaaaactcaagcttagtgttctggaaaacaacttacatgatgttaagtccttttatttatttctagcccacaataggagcgtgtaactgtttgaaaataaaattaaaaggagatagtgggccgggcgcggtgacttatgtctgtaatctcagcactttgggaggccgaagtgggaggatcacaaggtcaggagatcgagaccaccctggccaacatggtgaaaccccatctctactaaaattacaaaaaattagtggggtgtcatggtaggcacctgtagtcccagctgctacttgggaggctgaggcaggagaacggtgtgaacccaggaggcagagcttgcagtgagctgagattgtgccactgcactccagcctgggtgacacagtgagactccatctcaaaaaaaaaaaaaaaaaaaaaagcagatagagaaccacaaaaagccctccagacacactgaactacatgacttacatatcaaactcaacctttttcccctcaaatgctttcttgtctatgcctccattttatcttcattgtatccctatgagcaagtgaagagatacatgctgtaatgcatgttggactttatttcataaagaaccatgcaaatcaaaaccagtattcttttattatagaattatacaagttggaagacatcacgtcaattgcctaggtggtggtctcataatttctagggaattaaaaataaggcttcaaatgcttttctaccaattggaataatcaaatcagtaatatttcgatgacatgtacaaacttcatcaaaaagtagtcccattccaagggaatgagcatatttatatagtgtattcccaagaagctctcccttttcacatttcagggagcattgtggaaaaccagaatgttgggattcacacacatatcactgtctattttctttaaacatttattttaggctcaggagtacatatgaaggtttgttacataggtaaatgtgtgtcacaggggtttgcttaccaattatttcatcacccaggtattaagcccagtatccaatagtcttatttactgctcatctacttcctcccaccctcccacctcaagtagatcccagtgtatgttgatcccctctatggtctgcagattgtatcaaaggcttagtaaagatgtagatttttaggtccttatcacagcttatggatgagattttctgagcaaaatgtttaggaatatgcattttaattagctcctcaggtggctactatgcagactcaagtttgagaaccactccatgcaatgcaaatgaactagaagatgacctacagttaactgttacagctccctaaacatgtcccttaaaagggatgcacgtcaaaataactttctttatcaaataatggcaatctttcttaacacggcaactgaccattttatggcagcaataatctgtggaagcaatgggtacatatgggaatactctcagtgttgggttaaaaagtatcaaattgactaatgtctcatgtatttattacataaataccaatgtattgcaaagaagccatgggcagatcacataaaacaggaggaatcataatatagtactaaaactactattaggtcaattaattgctaaagtatgtttaatggaaaacaaatggagtttttattatgtaatgattgtgtgggaaattattacaatttatattcatatttcttcaaattataattttttaacgtaaaattggattaaaagtaacattgaactgtgattgaaaatcatataggctggtttattacgctgtcttaaattgtattcctggaggcaatactacaaacttcatgtctccaaaaggcatttcctaagtgctacttatcagatgtcaggtctcaagaaaacaaattccatgtacttgtctcaatatagaggaaatatttgcctaaaatctattgaatatggaagtgtatgcctgtgcattgagctatgaattttgagtaaagttattccttataatgccaggctatgtggcagaatatgttaaatactattatatataatgtttatatcttgaatgactactcattattctaccatccaactacataagacaaaaagaggttcaacttttaacgataccccattttagtgactaaatctttaaaaattattataataaaaccacataccccaaatgtagctgagatgttttcataatctacagcccgtatgtgttagtataactaagccacattcataattttatgaaatcagcagtctatggcagaaaaggtacaatagtcagataattaactacactaataaaaaactttccaagaaatcaaaagacctgaaccctagttctcctaccactaacttctcttgaaaaatttacttttcttccctaagtttcatttttctcaagagtaaaacggagttggctaatgttcctcgtggttctagcaatctctgatttggggttagactgtgattatacagttcccagcattttgttcgcctgctctaagtcactcagttccccgttactattgggctggaagaaattcactctagggcagtaacaagttcagttaattagcactctacctcaccaccattctccaacaacaagacaggcaaaagaatcatgtttttatttaactaaacacagggcaaaaactaatctggttgcttcttttgtagggttataatgtcactctcttaatgcaggtttaaaaaatctctgagatagtctgtagcatgataattggtatcactaacctgtgctgtactcttttcaagtttttggactaaattatcccaacaccgggcaaagttatccagccatgcttccgtcttctgggtcactgacttattcttcagtgttgaaagaagatcttgtttgagtgaatacagtttgcccatggattgctttttcttttctagatccgcttttaaaacctgttaaaacaagaaagatcacagaataagcctgggttgcattccatacaccactatagttcaatctgcttttgcgtgtatttgctcatttgcatagataagaaaatatttcaatcgtgcccgcaaaggatcaaaagttcagaaaaatagaggtagaaagttataatctatctaattatcccaagaagtttgaagagaaaagaagagaaaagaaactcaaacgtagaataaagacctactagaggtaattaagagctaccttgaaatatttgaagaaaatccaagtgaaaaggtaatattgcttcaaaaggcaaaacagagatcaacatgtggaaattagaaggcacggatcttggatttccccttaattcctgacggaattcaaacgaaaactgacaatcaggtaccaggagtactgaagaaaagctagtgagctgagaaaatgagaatggctaaggaaacttgccattctgaaatgctgtgattatttggataaaattacaatattattgtttccacagttttaacattcggttcattatttggagataaaatctcattatgtgatttactgaccataaaatttttgtagcatccattaatcaattaacatctggttatttgagtaattattttttaaaactaattgtagagcccattaagtaaaagaactaagtcgctgggcatgacataaatgcttcagcatctcttttcagagtttataaatacttatgtgtcttatgaagcaatttttataccatttatatttccaaagttcctgtgagctgtggagggttacaaactccctttggttgatttgaaaggaataagtggtttatgtgaaatcagtaaatcagggcagtttttcttttacttgactcagtaactttgcctgatacacagacaaattcaattcctgggtactgaacattactccctgacttaatctgtaaacaaaggagaagaaggaagagaaataaaggagaaaattatcttacagccacttaacaaccccatatttggcagcaaatacaatgaatgtaaactaaatcgcgatacctgtctttccgaaacaaatgtaagtttatttaagaactaacataccacagagcaaattgtcatgacacaaatgcaccaattgcccatgaagcaaagtgccccaaacctagagcagtcaatacaccttcctgaaaaggacaatctaagtagcccattttggcatggcacctgcattgatagctctgaactgcagaatgctctagtggctccttcaattagtttgtcttttactcagaatctgcttcacctggagtatgttatagttcagtcttcatgccatttttaaggggaaacaaagcaagatttaagtttcatctctaatttttccttaacaataagttcagtatttttctaagtttgaaagaatgcaatagaccaaaatacaaattaagatattatacactgaattcaaatcaaaataaaactcacggtgtgggggtttagcaataggtaggtggtttttcttttttgttttgagttggagtctaactctgtcgcccaggctggagtgcagtggcatgatctctgctcactgcagcctctgtctcccaggttcaagcaattctcctgtcagcctcacgagtagctggtattataggcacatgccactaagcccagctaatttttaaatttttagaagagacaggagtctcaacatgttggcctggctggtctcaatctcctgacctcaagtgatccacccgccttggcctcccaaagtgctgggattacaggcatgagccaccatacccagcccaatagataggttttgcatattcattttgtttaattcacttgttagttttccattaaatttaagtgaatatttgcattagtactagaacaaaggttgatgctacctgtcccaagctgagagccatatttgaatttcaatgtatattcctccagttatagtgtcattttttttctttactatggaaagaggcacaatatacacaaagacacaaatctaaaaataaaaaaaaaatctaagtacaatcctctttgacttacttactcagaatgttagaaactattttaaatagccatatgtgtaaggctgaatggtctacccattatttaaacaaaatatgtaatgatttggaaacatgtcagaagaggagtgtgagaattatgtttaaagaagaggattgcaataaaaacctatgagtaacctcatggtacctaaacaaatgaaaataagcctcctgttttattattaagccacatgaagaaacatttggtaagcattacaaaaatgaaagtgaaagtcaccattaaaaataaaattagaggtggtggctcacgcctataatctcagcactttgggaggctgaggcgggcggatcacgaggtcaggagttccagatcagcctggccaacatagtgaaacctcgtctgtactaaaaatacaataattagctgggaatgttggtgcatgcctgtggtcccagcgactcaggaagctgaggcaaggaatcgctggaaccagggaggcagaggttgccctgagccgagatcacaccactgcactccagcctgggcaacagagcaagactccatctcaagaaaaaaaaaaaaatccaattaggaaaaaagtgcactcaaggtaaagtaaaatcaatgttataattacattgtgtgattattgaataaatgaatttttatatgtctgtatgacaaaaacactgaacccagacttatacctagtaaattttagatatgagtatcaaaaatgatgatggcagattagttgtttggtctcagtttctctctctttttctgtctttcagtagtcatctcccagttccagaactcccccaggattattaactgagggaggaaaagaaagaaaatccatgatggggccagatacattagatcatagaattcattagaattaccttgtcctgtctatccattgatgctgattcttttaagcttaggtcttacatgtgcatattaaataactatgatttgttactaattattgcataaaatatgtatttctacatatcaataattaaccataggtctatgagtgccagagacccatagagctctagaaaattcaggtggcaaaaggaagatctagagaatgtgtacaaggcaaaggccagctgggatagtaaaagaataaacagactttatttttatagaagccaggaatgtagacctacctccaaggtagggaggaaggtacagtcaataaatcagactgggtcagtagtggatatggagaagagacagataagctgttcaagatgatttgaagtgaaaagataatgtatccttacaaaaggcccaggaaaccttcacctcactctcatcaggaatacgcataagagaataatgccaagacaatttctcctatattggcaaaattgagttttccacctatattatgtgtagttacttatctacatgtaagatgtgctccaattcattctaatcaccagttgtactttgggaggttgatctattacagaggttctcatcttgaaagaacatcagaattacctgaaaggcttgttagaatgcagatgactaggctccacttccagagtttctaaatcagtaggtctgaagatggcctaacaatgtgcattcctaacaaatttccttgatactgatgctgccggtcgggggaacacattttgagaagcattgatcctgtctgaattaattatttgagggccatcccaggagttgaggtaaaggtagcaagtcaaacaggaacttgctcagttaccatgagcacttcatccatgtcctttgatcccacagccatttgagaatatcttcaattcctaagtacttctgtagcccttatataccataatctcttggatcaccctgcttccccagagctgtccttccccagcaaacgccaacagtccccacagcagaaatacatttactcaggaacaggtttcttcttgacttggatcttcccacgataatttacgtgattctacaagtcttataattcacctcataaaagctactgtttcttctttcccttcatttttatccctgatgccaaatcagtttaaaacttaaatcagttttgattataaaaaataatagatctacatgatttggatatgaatcccaaagatctagagcaaattaaatgtcataatccccacctcccacctcaatggcaagcaggacacaatcccatgggttatcagtgatactattttgaaacaaattacacttattgtaaagagaagagagtttagcacagtgtatctatacctagacatgtagtgaaaactggtgacagatggtacctgttttgggtctcagattgtgacatattttaatgaacattaaattcttattcactgcctgagtcagcaaaggaattttacctcaaattctagaccagctgtcaggttttgttaattggcttaaactatcaaatgacaagacctatagaaaacatattttctctttgttcacaagcaaggtgacataacacaaattttaatcctattggaaaattattgactttcttaaaagagcatttttatggccctgaggctagccaagatttctgctcacaaaaatgttaacatagaggcacattattgttagaaatgacagttctcagttgcagttattttttccaaggaatcaactgatatgaggactactgaaatagattgaaaggcctggacctgagtctggatgtcttagtgttcattttaagtctgatactaatgttgtaggatacagatcctgtgttttttcttgatctcgattttctcttggaaacaaactgagtagatggtcctaatgaactttacatgtgtaatgagattgaagaaacactagatgagatgcaaaatctcatctagctttaacatatttggattttgtcagtttgtggcttcctaagaacaactttcttgattggtaaatctagtcaacaatatatgcaggaactttgactagatattaagatttggaatttatcatcatgtaaaataactgtactattctggcatgtggtactttccaaagatggctgtaaaatatcctcatctcagatgctttgctataacttgaccttggtgtttctccatgaggaaatgaaatctaattcccttttccttgaatctgggcaggcttgtgactttttcagcacacagaatatgactgaccatcaccattatgattgaccgtctgaagcacatgattctgtatttaactagcaatatatcttcgctcctaatcagagggcatgactgcattttgataatcagtggtcactcacttatttactgaaaggattcacattttgcctgagaagaacaatgtttgtaaggaatattctgctttaaggagatgtaatccatgcatccattcctctagatatgatagaatccctcatgaatttatcctctcctctctgtggcatgtgacagtgtgtaccacttcctacttttttgaaatctttattctcctcacttttgtgataccactttccccttgtggtatctgctcaatcttttggtcaacatcttatcctctgcctactccttgattgtagacattcctccctgaaatctattcgtttcacttaatgtgtcactctacacaatccctcagaagcattttgattgcttctgaatcaataactagtcatgaaccattttctgagattctagttgtgtaaaccaactgattaatggaaaggatttttaacttggatgtctcaaagacattttacacggaatatatccaaatctgaaataattatcatttttgtcattccagcaattcctcttctattctcctgttagggctaataaccctcctaggaacccagtcacccaaatgaaatgtctaggaaccatttcaaacttctgcctcttatcacaagtttcattcatcacatcttaacattctaatgtttctcttcttatcttaatgcccaatgctacttagttcaggtcttctgattagtcctcgtaccatcaaacatcttcctaccaaaaagaattacaaaaatgcaaatatgattcttttgcaaactctcaatggctccccatcagctgcaggccaaaactacaaatacagctgatatttttgcactcgtgttttcaaacatatacaggttacttttctgaactctattttcggcagtcacatcacttaataaagtccatattctttgagcaataatttcttatcaataataagctagcttgtaataacaagtaatacataagtgaatctattttaaattaaaagaccaatgagggttagcatttatggagcaaaaaaaatgtatgaaacaaataaatagctggtaaaatggtacgtatttaaaatgagtggaaaaatttacttaagtttagaaattattgcattattatgaagtacaatgcaataataaaggtgaaattatggaacactacttacaaccattttgttttataaaagttcatatcaaatgaacatttaatcaaatctatcaaaaattttaagaaatcataaagtagaatatgtcacgtgaaaaattaaactcatagtatcagaccggcctcttttactagaaatgataaaattcacagagtaagagaaactttagagtttttttttttttttttaaatcttggaaattcctgctgaaaccaaatgcttcaatgaagtcttttctgaaatccatttattgccaaagaaatctcattctcaaaacactcgaggtatttataatcaatgtcatttgataggctttaatttttttttgcttgaaaaactaggtgatattgtttggatctctgttctccaaatctcatgttgaaatgtgattcccagcattggaggtagggcctggtgggaggtgattggctcatgagggcggatgtctcatgaatggcttagcacaatccctttcatgatgagtcagttcccattcagttagttcacatgaaatctggttgtttaaaagagtctgggaccttcctcttatctcttttgtttccactcttgcaatgtgatatacactggctccccttctccttctgccatgattgtaagcttcctgaggcacttaccaggagcagatgctggtgtcatgcttcttgtacagcctgcagaaccatgagccagttaaacctctttatttcataagttacccagtcccagtctcaggtacccctttataataaactaaggttaaactccatcaatgtcaggataaccgtcgcttgtaactctcacatattattctgagaatcaacgtcagtctatttttttagaactatgctgcttagaactttatgaaaggctcacagacatttcttagtattactttattaattttaattgaagtcttattctggtatgctatgttttatcaagagtacaactttgaaaaacaaagttgaaaatccacctatagttttttcccactttaattcagaaaagtagcaatataacatctttgaataatctatgatccaagcaaaaataaacatttaatattcaatagcatagaagagactaaataatagtgataatatacagtactgggtttttataagaccattgaaagctagaaagtacatacggccagtttttgaagacttgataacatttcattttgatctttaaagccagttgtgtgaatcttgttcactgcatcttctttttctgaaagccatgcactaaaaaggcactgcaagacattaaagaattccaaggaataaataaacataaatctttacttttccaatttaatatccccccgtgtcttttacagctagtttctcacacatgacacacctgttcttcagtaagacgttgccatttgagaaggatgtcttgtaaaagaacccagcggtcttctgtccatctacagatgtttgcccatcgatctcccaatacctggagaagagacaatcaagcacagcatcagcaaacaattggtaactacgttttattaaaaatggcatgaataatttgccaaagtatctcagtctcctatgtacgctagaagttggaagggacactctttctgatctgcttacatttaaataagtggtgtgactgtcatttgtctttatctcaccaagtcttgtacctttcatagaaaagcaaagagacaagcaatatgaagtggttattataccactatataaaatggctccatagcaaatgtaagataacaaagacatacatatagagaggattttgcagtgagaacaagtaaaaggtgtattttccttaggtttgaaaatacaccctaaagaataaaagtctaactactaaatagaatgcctcaaaagactcttaattgaaacaatcttgcataatgagaattgcctaccatttggattgtagaagaaaattcttagtaacttaaattctattactatgtagatttttcaattttctcaattattacaaaagtattaaaattttctgtttctaaactactctagtgagaaaactaacaatctctgagtaaaaactactatatcattaacatgtcactaatgtctaagaacacacactattttaatatgtaacataaaccaactatcaatgatttttggaaggaaaacaaatattgtgatgctttctatgcaaaggaagcatttcaaaatggcagttagctcaacctcattatgatgcactttatagcctgaattttcaactttttgtaactttttcatataaataagaaacttattttctcatatatatattggacctttaaagctagaaatcataaaatattgacgtgctttattttatatagaattagagttagaaaaatgtttataactcatatttttgaaaaatctactcagtgtctaaggtctcataatttctatgttactttatactacatatgtgtattaacccacctagaggatattaacacatgatttaaacaatgcaaatgaaattagcatcatgaaaataatccacctattttttttttttttgtagacagagttttgctcctgtcacccaggctggagtgcaatggcactatctcagctcactgcaacctccacctcctggattcagggaattctcctgcctcagcctccccagtagctgagattacaggcatccaccaccatgtctggctaatttttgtatttttagtagacacggggtttcgccatcttggccaggctgctctcgaactcctgacctcaggtgatccacctgcctcagcctcccaaagtgatgggattacaggcatgagccactgcacctggccctaatccacctatttctaagtgactaggagagtcacgtttcttaaattgtttaatctatcaccacttaaaaaaaaatacacgcatgggtaaacagaaggcagtcaacattttcctacagtattaacataatcatgtacttatatgcagctcaatcataagtgagttttcagtttttcttcataaatatcaatgttattgctttcagcataatgtaactgttaattttttgtagtttcactttctactcaacttattttgaattatgtttacaataaaagccatagcgctcaaacagtgatgcgagatacccacaggaaatgtgcgagcttaaatcaatgaatttagtcacttcaaccatctaattattacgaagcagtatatataggttttttctaaaacatacttgcatttttttagctaacttcctagtgaccctgtcagtgcatgtcaggtaaaatggcacgtaacaaaatggttaatagattagttgtgggagaaaaaagcttcaaatggagaaaatcttatctcttaagtataaactacaccatctacctgacgtgatgatgcagatctacaaagtcaaaatgtgggaaatttattgtagcccatcaactccagtgaagaagacagtcaagggaagaagggacaaactcaagctatagcatcatattcataaacaaaaaagactttcaagtatatatagcatcttctctctagtgctacaagacatatagtatccactgaagcagcattttaagcttgtaaccccataggtggaaatgtataatttattaattttagtgggaatacaaatccaaataaagatcccctattccaggttgtataacattttcaaatttattgaaattctgagatgtactaatgggatgcatttaatattgcagttttgttcactgtatgagtcacaaaaaactaatagagtagttctcctttatccataggggatatgcttcaaaatcctcaggtggatgcctaaaactgcaggtagtacaaaaccctatatatagtatttatgaatttatttttctttcttcgcaatttcacggatagacttgctcttaccacagattttgagcaaccccagcatgcgatttttttcttgccttattaagttgggaaccttttcacataaagaaaacccttcacagtttttctttggcatatttgaactgccaccataactactcttgcactttggggccatgactaagtaaaactagggtgacttgaacacaagcactgcgataccatgacagtgtttctaagaacctagacaggtactgagtaatgggcgggtaacattgacagcatgaagacgctggacaaaggggtgattcagtcctgggtgagacagaggtgggatagcacaagatttcattatgctactcaaaacagcatgcaatttaaaatttatgaattgtttatttctggaatttttcatttaatattttctgactgtggttgactgccagtaattgaagccaaggagagcaaaaccatggatgagggagggagggagggagggagggagggattgctgtaattaaacactcttttaggtacataggcaacctatttaacataactatttaaaaaatgccacttaaagtgttctttatatccaaataatggagcaagtttatgattcagctaatatctaggttacagttaatgacagccatcaatgcattcattcattgatcatgaatttattatataacaaatatgtaccaaatatctggatatgccaaatattaagagaagatgttacaggctcaattgtgtcccatgaaatccatgttgaagccctatgccccacctactacatcggaatgtgcccatatttggagatagagcctataaatagaccattaagttacaatgagtctattagggttactctagtccaatatgatgggtatccttatgagaagaggaaatttggacacagcaaaacaccagggatatgtgcaacacagaggagagaccacgtgaggatacaggaacaaggcattcatctgcaatccaaggagagaggcctcacaagagaccaatccttgccagtaccttggtcttgaacttctggcccccagaatggtgagaaagtgtttgtattgtttaagccaccagtccatgttattttttaatgatagccctcacaaaggagtaatacaaaagacaattaagatagatggattctttttcaagaaatacttggctaaatgtctgtcgaataataataccaacccgttaaagaattgcaaatgttaaacaagagtatgtatgggaaagtattattaatttgaaacaagttatttaagagttggtcgttgtttacaatttgcttgatcatggttcttacatcaaatctaagaactgccaagggtcatctattttactgtattcactgtagaaaggcacccattaaatctttacgaataaatgtttagtcttcaagtatattctttaaaggtttccaacacaagacagcatgaacacatatcctttagtaacatattctattgcttaaacctatcttactcttagaaaatactcaatgaattgaatctaagtcacttctgtagcaaggcaggcatagtgctttccactgatctcagtgtaagcggaaaagtgaattagaaattacttgctcatacgctgtaaacatctgcccatacatttttgtgatgccatatgcacaagtataaatagataatacacgaagtgctttaaatttatggatttacctatttattgcttagcaatattggccttaatttgaattacaaagaatgaagcaaagcaattggaagactatatccctcagctctggaatcactcaaagatgctggttcctatcattgcctgaatggctataacaaaattgttagacaagtgtaagaaattggataaaatggggctaatacatatattttttaaagaaccactgtattaggattagaaacctcttctctagagaaaaaaaaaatatgtaacttcaactctgtttctctgagtttctatttacgtataggaatcccttgagcttttagcaataatgcatatttttatagagctaaacattctacacataaatgtaaaaccaatgaattacaaagtctcacaaaatggtaaaagaagttaatttttatttatattctcattttgtctcagcagtaagtgaagctaaaggtcagctcacttcgtctaacattttcatggactaaatcacaactccattatcgtccatgctcagatccacaacggggaggattttttcctcccatttaattcacatgtcatattgttgtacgtgccaaggacatttctcatctgaattcctttgtttggttgagttgctatttcaattcaaaagtgaaaaatggctactaaaagaacatttggataaaggtaactgaggaaaatctgacaagcctgggaggtaaatcttaagtatggtgacccttgaatttactggagccagggatagaatatgaaacctaaactgtgcccatcagtattggcgttaagagatagagtgttcccaggcgtatatccactaaggcggaaacaattatgtgccatggaccacacaatgcatcagcaacggggctttatgaaagagggaggcagaaaacaacccatcttattttattgcaggttaagaccctataatacacttctctgctaaatgaattttatgtgtaatgagccctctgaaaatcccttatttcttgatttttctcttactttatcaacaactatgcagttaaaacgtataagcaacttactcttactgatgttgaaatggaaatcacatcaaaaaccattgaaaaaaacaaaaatccattatgaggcagaaatgtggcagagtcctactgaatagtgtttagccaagggtatggcttggttctcagttttacacatttctacaaactgaactgaagcaccatactataaaatggtgtaccttatatcttcactgtataacatatggtacagggcggataaacctattttgatgagttatgaaacaactactggaagttttttcaaaagtataattcttacttctatttaaatgatcctgtaataatctcctgtctgaactcaaggaatttttagctgtcacttccaaaggggcaggttacagatgaggaaactgacagataggttaagtaacttgtctgaggtcacagaagccacagtactgagtgtctgggatttgacctcagatccatttggctacaagttcatgctcgttcataatggtattcattcagtagggcattcattataaaagatatgccttctaatttgtgctacacaacctacagtgagatatccagatgccgaatccctttggagtcttttcatattttgttttagcagaagtttgactagatttaacatttaatctaatctgcttcacaaggatgtgaagcttaatgttataatttgattcaaaaacatttgacactgtaactctgtatttgtttaatcataaaacgtcagcaaatacttgcacttccagattaagaacatgtggcctttgcaggacttatttttaaaaggtaagtatgactgatttgttcattaaattctgcctttgcaattgtgctgaaagtgtagtgagattttaacacgaagaagcatgttcttctctacgctatttcagtcagtttcctatattatttatttgtgtgagtatacaaagtgctaatgaataaatctggaaaagccttttgttgttgtcactgctgttattctttgcaggatattatttaatgtcttttttttttttttttggcagcttaataaactctgtactctccagctcccaccagtctgttcaattgggataccagaaaataaagagcaggagttctaaggagcattccagcgtaacagtgttccttccagcattcatcacattcccaggcattccttggtagcttgaggtttcctcttccttatcgttttatacctcgcagactctgagctccttgaggtgggctccttacctttgaggttaatgtcttgcacaaatatcccaaaactgaatactactactgtcgttatcaataggtggctttccccacccaacttttgtcttagaaccatcttttttggatctttcaatctgctaatcattacataaagtataaacttcctgcattcccacttcagttctactgttgcccaactttgtaatatctgtgaacaaactcaatcttgctgtgctttagttttctcaccagtgaaatagagataatagtacagactctcctagacaggtaactgctagggtcagatagatcaataaatgtgaaagtgctcttaaatctgtgatgaattattgagatgcttgtgatagtaaggatttagagctcagtcgataaaaaaatcagcctttattccagatgtgataaatctggagcatgatagaattttaatatagaacacagtgaaacattttagaaggacaattaatgataattttttttgcatttttttctatacttgataaagcttatgttttatacaagaattgaaaatttttacctttacaattttaaacaacagggccatattccaataggtatcctttttttctttttctttgagacagagtctttctctgtcccctaggctggagagcagtggcgcgatctcggctcactgcaacctccaccacccaagttcaagggattcttgtgcctcagtttcccaagtagctgggattacaggtgtgagacaccacacctggctcttttttgtattttagtagagatggggtttcaccatgttggctggtctcatctcaaactcctgacctcaagtgatctgcccgcctcggcctcgcaaagtgctgggattgcaggcgtgagccactgagcacgggctccaaaaggtatcttatttgaaagcaagtgcatagaagataaatatccctctatgtctcatgccaactcttgacatcacaacttttcatccacaagaaatcacaaattctaacgtacatacctaataaaatgcataagataatgtaggtgtaacagaataggtagtaatggggactgtggctaaatgaagagcctgtgctagagaaaacagggcaacttgactcctgctctggttactatgtagaaaaacagactaaggatcatcagatcatttgctttctctagagaggttagaaattcttagttcatgtcacatttttttcaatttcaaacaatggtagctaataaactactattaaataccatagggactaaatagaactttatctaaatacatctgtaattttagatgcaatagaccaattcctagaaagacacaaatgattcgagctgactccaaaacggaaaatctggaaaaatgtaatgttgaaattccaattaaaaatggacatttttatgtgtattaaatacataaaaatttaattttaaaatttcccatttgcaaattccagttatgaagccagttaccaagcctgcataatcaggtacttaaacctagcaagcatattacaagaaaggaaaataacaggccaatcactttcatggacgtaaaggaaaaactatgaatcaaagaaaatctagcaatacacaaaaaagattatacgtcttatccaggtttagtttattacaggaagaaaggcttttttagcattagaaaactaagtcatgtgatttgacatatagcagaataaagaagaaaaatacgaccatctcaaatgattctggaaaaatatatgataaaatttggcatccggtagtgataaaacctcttagaatattaagaacagaaggtatctacaacaaacctacaggaaagatcatacttaatgattatttattaaagttcttccctctgagacttaaaatgagaaataaatatccacaatactcccattgtactagagtatttatacagtacaatatgtcagggaaaattaatgacatgaaaaataattggaaagggagaaagaaaactgtcattactcaaaaacaacctatatatgtacatctgaataatactacagataatgtattcaaattattaagtaaatgtagcatggtacctggatacaagaccaagaaaaaaaatcaactgtatttctttatatcagcacaaatagaaaatgaaatttcaaaaatatattcataacagcaaaaatataaaaacccaagaaataaatctcagagaaagtttaagagcctttactttaaaaactataaaacattattgagagaaaataaagacctaactaaatgaaaggattgaaagactttacataataaaaatgttgattctgtacaagttgatccagagaatagatgaaatccaattaaaaccacagcagattctttttgggggcagggttcacaagctgttcttaaaattcatatggagatcgaaatggccaaaagcagtcaagataatctttaaaaaggaagaaaataaaatggcttttactgaccaactgaccaaaacaaacttaatgtgactaaactctagacaggcttttatttgactataggctcctgacctctcttttcttagagcgcttactttagggaaacttgcaaccaaaaacatattctctgcctctttgagatgtaaatcttctacaatccgggaatatctttctcaaggacctaggagccatctctttgaaatgtaattgttaatgatagcacgcctatctcccagtctctgtgggacagtaggagcctaacttcattaagtgccaattaacaatcacagattgcctaatcaccatcctaaccccctaatatcttccagtatttttctactagctctcctcagtgcttaaattctctcctgtctttctttcagtagaaatgatttccatctctctctcctatggcaatagtcttgatccataattcagtagtcttgaataaagtctttcttgcctgtttgtctggtgcattttttcttttacaatattaccagatacaggctgggcctggtagctcacgcctgcaatcccaacacttcggcaggccgaggctggcagatcacctgaggtcaggagttcaagaccaacctgaccaacatggtgaaaccctgtctctactcaaaatacaaaaaaaattagccaggcatgatggtgggcacctgcaaacccagctattcaggaggttgaggcaggagaattgcttgaaccagggaggcggatgttgcattgagctgagatcttgccactgcactccagcctgggtagaaacagcgaaactccatctcaaaaaaatattaccatatattaaaacttgtcataatgctatagtaattaaaacaatgtggaattagcatgaggacaggcaagtagagaaataaaactgattagagtccataaactgatccatgcacgtataggcattttatttctaatattttcgtcaaagatgacaccacagaatattgaggaaaggatggtcttattgaaaatctttgcaataagaccatcttttcctcaatattctacagtgccaacttgttgtttcagttggatctatatgggaaaaaatggacattcatcccttcctcatacctgtaataataggtggattgtaatacgaaaggtaaaacaaacagttcctatatagcaacccaggaccatagcttcagaattttaaagtagagagttttatttttaaactgaggacaaaagtacactaaacataacagaaaatattgaagtgaactatgttaaatttaaacttctgtttatgaagagatatatcattacggagtgaaaaggcaaggtacccattcaaaaagaaaaatgtaatataaacagcaaagaatacccagaatatatatattttaaactaaaataaatcagtaagagaaatatagaaaatccagtagaaaaacaggcatttcagagaagagttcatttaaatggccaataacaactgaaatagtattccgcctcactggtcatcagtatatacaaatgaaaaatgagagatgacattataaagtcaccagaaaggctcaaattaaaaagtttaacaaacaagtattcaagaagatatgaagcagtttgtactttcatttactactggtgagaatatgaatttatacaactttggaaaaccctttgttaatatcttgaaagctaaatatgcatatacccaatgattaagaaatgctattcttaggtaaatacctaatacaaaagtttacatatatacacaaaaatatacgtacaatttatgttgatagatgaattatttgtaatgcttccgaactggaaacaaccccaattttctgaacagaatatgtaaaatgtggtatattcatacaaagtaattctatccagcgatgaaaattaataaagtaatgctatatgcaacatagtgaatctcacaaatatagtatccagtgaaaaaagccagttaaaaaactgcatatataaaagtttcatttacatcaagttaaaaatatagcaagactaacctgcagcattataactcaagatacatgttacctttgaggagatgggaagagtttatgataccatagggcttgatggaggtttcctggttgctggtaacatactatctttttctggatgtggaatcatagtatgttacttctgtaataagtctttaagctataattataacttatgtcctttgcttgatacttcaatttaaaaagtaccataaagtttgcatttttttttcagaaccatcaacagataaacagataacaggttatatatacataatgcaatgttatttggccataaaaaggaatgaaatatagctatttgcaacaacataaatggaactggaggtcattatgttaaataagcaggcacagaaagacaaataccacatgttctcattcacatgtgggagctaaaaaattggatctcatagagctagagattagaatgatagatactggagactgggaagagtgtgtggatggaatgaagagaggttgtttaatgggtacatacgcttagatagaaggaataagttctaatgttcgatagcagagtaggaagactatataattatatacaacagtgtaacaaaatatcacatgtactctataagtatgtacaaatattatgtatcaataaacttaaaaattttttgtaaatgtattaacacttgcattcataaagaatattattggccgggtggccgggcgtggtggctcacgcctgtaatcccagcactttgggaggccgaggctggcggatcacgaggtcaggagatcaagaccaacctggctaacacagtgaaacccatctctacagaaaatacaaaaaattagccaggcgtggtggcaggcgcctgcagtcccagctactcgggagtctgaggtaggagaatggcatgaacccgggaggcagagcttacagtgagccgagatcgcgccactgcactccagcctgggtgacagagcaggactccgtctcaaaaaaaaaaaaaaaaaaaaaaaaaaaaaaagaatattattgttccagcatacttgcttatatttcccctgtaattttgtatggtgggtattatgatcactgttatctttgagtttcatttgataatttttatcatgagagaatttattgttcaactcataaattataaagtcagaatagaaaacagattgagtaatccagacattgtgttctttcaaatctacctaacaccctattggccaaatgtattacaacagaccgtgtattaacataaattgaaatctagcgttaactgtatacttacagcacattggctttggatgttcaaatttcattagaatattcaacatttatttatacttgatacaatgtgcagttgaaaaaacaatgcacatatcaaagctgatcaaaacatactcaaaagttttctaataactgaatcatgtgccattttatatttaagtaaataaaataaaaaatccagttcctcaagcataccagtcacaattcaagtgctcaaaatagccaaaggtgtatagcaacttccttactgaacagtgtcgttctagaaaagaaaaaaattttatatactaatgcaatcgagtgtgacaggtgttaatatatatatactgcttatataaactatatacatatataaaccattctcttctagaacagtgttgttctagaagagaaaaatatttatgtactaatgcaattgagtgggacaggtgctaaaataaataaatatatatgtttatattatatatatttgtacttgtaaatttaactcattcatgcaaatgctatatctattcatatatatatgaatagatattgcattttatacagatagatagtatttgcatgaatgagttaaatttacaggtacgaatacattactgtgttacataggtttctgtattcccccgttgctgattagtaaaccaaaactgaaaaaaatcacataattttcacaaggccacatagcaaatttctactatgaatttgagagattgggagaaatctcaggttgagttgtcacacatctgaataccagtgtcagccttgccacctgcaagctatatgaacttggatttaacttcattatgcattggctttctcatttgtgatatagggttggcattacatacaaagcatgtaaaactcctgaaaaataataatctaataattataattattgcttcttgggcaacaaatgttgatgcttagctttgtggattatttccatcacatttaaagttttttttaaatgcatttaattcaccaaatataaaattaggaactagagcgaaacatcaaaatgtttcaaccatattcctcttcataaataacttctatttcttaatttgatagggtctaacattctataaaattttctttctcatactatcccgaagatatgtactataaaaatttcagttacctaactgacatttaggtgatgagagaaaaatctgactttatcgtctttctgaacaactacctttcacagtatagcattttctttccaagtggctttgttattttaacattctctttgtaactgagatatagcacattccctttgtaacctgtgtgatactcatgttacacaagttaaaactattaacgacactaacagcaatgtccaaagagatgttaccattaaatgtctgtcattcttattgtctacttatccagatttgtcacctttaaaaattatcactgttggtcaaaataattggcagaatgtagtatttgacttctttatattttgccattatattcagattgttttttcttatgaaagtaattttgagaatcatgctttttaaagctgaagttctctacagaatgagggagaattatgcttctactagataagattgggcagtatttccttttattttcttgcactccacctgtattggaagggacattggaggctatcaagtctaacttcccactcagtatgtcacctcttttaaaacatacttgaacatgagattccagtttgtgttaaatattattaatgaagaacagctcaccactttccacagctcttatcgcattgtaagaatgctctgggctgatgatgataataatagtaactaatattattattgcttactatatttcagtgatttttaaatgctttagcttctcaactacccttttaccctttacagatatctgataatgtaggttctaatacaatcttcatattaaagatggggaaactaaagccaaggatggttaagtgacttgcccaaaggtatactgtagataaggaacagagcaggaagggtctatttctagagtttctcctcttaattaccttacaacaaaaagctctcccttttaagtcaaaaaaatctttcttggaattatatccaaccgtctgttcataggttcattcagttatcttacaagaattactgattacttgtatctgacaatgcaggcaagaatgtgtaagacacatctcatgtaatttagattctaataaaagagtaaagcacattaatattaactgcaaaagtatatgatcggtgcccaaacagacacaattagggtacagacatggcacaaagagggagtagtcatcactaggtagagtggccaatttcatggaggaaaacttgaaatgagttttctatacatagatgaaattatcaaagcagatcttatgaagcagagtcgtctgtttaaacccggtggtatgtgcaaagaggtcgtaacatacagggtatcagaaacagcttgtatgaatcaaatgcaggttgagggacataaagcagataacatgagacaagtctatagagactggtaggagtcaggtaatcaaataccttgtaggccaaagtatcagaatctggaaagtgactcaggattttaagcaaaggagaacgattaaacaggctcttgggaacccacactgacttcaatgtggagattggatggaagagcggtaagactgaaggcaaggactttgggggcttatgatatggcctataccttgagaaatgttgacaagaacaaagatgaaataataaatacaagataaggttgagaaatattttgacattgcatgcaaagggctcataagggaaaggacagggatgaatttggggatgactctaggtttctggtacaggtgtcatgataagtgccagtgcaatgacaaaaataagaaattcagtaaggaaagcaggtttaaaggaaggcaatgtacagtgaggtaagtttcatcttgttgagtttgaagtgttgtttggacttcaaggatgtgttcagaagataattagaagaaaatggactcaggaaagatctgggcagaagacatccagagttaccaacttctgtctgcttctgatattatgacattttgaaaaaccatagagaaagtgccttcctttttcaccatcacaatagtgttcatgtgccatttccctatgattagttattttttaattaaataatcgcccactctacaaatattcttcacaggatgctgccatctgagaaaatcctgctaagatagagtaccaatcgtgggcgtaaaatacagtgtattcaaatcagcatagagtataattattagttcatgtaatctagacactatatcacagtctgtgattgcattaactaagaatctgtatcatccttaatatcaagcttgtttcaaagtaagcatgtgcactctatctcatatgtgcttatgtttatgtatatgtatgtatatacatatatatacatatgcacaaagatgtacgtatgtatatatatagaaacataaagagatgtatataaatttaactatatacacatttatacatatatttttatatagacaaaattacatgtatttttacacacttacatttatatatatttacatttatatctatagatgggaagtcagaccctttgtatctcaaactaattcaactgatttatactacttgcatttttaaaaagcagcaacatttcgaactataaacatgagttttctgacttaaaacaataggatgtaacatttgtatatgatattctaactcctcaggacatagctataaaccttctaagttaatatgggagcagaaatattccattaaccactcctacaggggcacactttacacagagccccagctaaatcctcaaatggcttccttccccagaattttcagcacgtaaatcagatactagaaaggaatatattaaaacacagactcacccacgaacactcatagagaaagatagactcaccttaccaataaacagtatcacgcagaggctttgctaaaaggttcaggaaaatcagaatacctcaaattcattccattccattggatcagccaatttaataagtctaacaaaataatttgtcttaatactaccacaaagtatttctacaaattgtttaatgtcatctgatataaagttggtttacatgactcaattttagcgaatgtagcttagttcttagaaaactatctcatctgcaaaaattattccttcaggcaataaatatgtttattaactgcatgagataagtgagaaaccataccagtgagcatggcctcatgtttaataatctgatccaaaattgtgttttccaggttttccttcttgaaaatagaatacttgttgtgacggttaatattatgtgtcaacttcatggaattgagggatgcctagatcactgatgaagtattgtttcttccgggtgtgtctgtgagagtgtagccaaagaaggctgacatgtggaccagtggactgggagaggaaggcccaccctcaatgtgggtgggcaccacccaatcagctgccagttagactagaacaaagccaggagaacagggataaagtagcttgcttggtaagtttactcactctcttcctgtgccctgcggggcagttggcttcctctcctcctgccctcggacatcagactccaggactccaggttctccagtctttggactgggggacttacaccagtgatttcccaggggctctaaggcctttggcctcacactgagagctgcactgtcagcttctctggtcttgaggcttttggacttggactgcaccaggctactaggttctctcttctcccagcttgcagatggcgtatcatgggacttcaccttgtaatcatgtgagccaattctccatgataaactcctaaatgtatattttatatacacatatatacatctatctatccatccatccatccatccagtgggttctgtccttctagagaaccttaatacactctgtctttatccattctttataattatttttattaggaaaatcaaaatacgatatgatagtcttgctatgttgcccaggctaatctttgaacttctgggctcaagcaatattctctccccagccttccaaagtgctgggattacaggtgtgagccactgtacctagcctcattcttttcatatacttttaattctccaaaatattaggcagtaacttcaatattaaagtattttaacaaaataattcaaatgccttttatatggcagaaattctcctggttctatgaccacacagaccttcaatacatctatagttggctctcaacttttaacttgtacagaataacatacctaaaaatagggttttaatggttttgctttttctttggaagacattttcattagagcatcttctataagctatgggcttaaccatgtttctccttctttctttattagaaacagttatctcccaagaacaaaaggctttctttatggtctttttatagtcttttttcatgcaagtttttataaaccacgctctcttgatttaccatttatccatcctagaaactctacccacctccaccaatctcacttatgatggcagcagcagcctgtctggagcggccactgcaaagatgccagctgcagcaagggaggcgtggccagggctgtgcactgtgtggagccaccaagggccaggaacaagcaggagcgctgctccctactgagttggcagggtgggagccccatgcttccaggtgcagctgcagccacccagccacagctccggacctgggcattcctgcgctcttgggggcctgggaagcccccctgcctccacatactaagaagtgcctgctcccactccctggcatctcctcgctccccgcactggctcctgggagaagcaaagttgcggccaagaccaggtgttgtcgcaacctgactggttatgtgtgtgctcgggacagtgctggcatgccagccccctgctgccttgcgcccgtctggactttgggcactgatgagcatgggagagaggctgagtggggactgaggatggttcggtgtgggcctgcaggtaccccttggtataaactgcctaggctacatggatggcatgttgatggtggcaggaggcagactggctcctgggcagaaaggagcagatccacagagaaacccctccttcaagccaagaatggcctgaagcctgggggctgggctgccagttctgggtggagtttgtggcccagaatgagaacttatggtgctttttctgggcctatccatggatgtccatggaccaattagaatgtacctcctcccttccgagcccataaaaaccccagactcagacaaacttagacattgggactaccagccgcaggaaggagctacctactttgtgtctccttgactcttcaggatgacctgcctgcataaaggagccacccaccatgggtctcctctctactcacagctgcacactccctgggacgacctgcctgtggaaaggagctacccaccgtggtatcctgagagctgttctctcgctcaatgaagctcctctgcaccttgctcaccctccagttgtccatgtacctcattcttcctggacatgggacaagaactcaggacttgctgaatggcaggacaaaaagagctgtaacacaaacagggctgaaacatgccccccactcaccatgctatgggcaatgagaaacagagaagagctgtggccttttgcagagcccagaccttggggctcctcaagccagggttgtggcatgctgtaacatgctccttggggctctgtggttcctggtgtctctgagctttcaggtgccaccgcgatcccctgtccagacattggtgcctgcagcagaagctacttgtggtacatctggtccagccacagcctcacatggagctgccaccagtactggtgcctgtagctgccttccgctgcagctggcatgcctgtctgtgcacagtggccaggcctcatgctcgcttgctcacatacctcttactgctctgtgcctggcttgcccttggcaggcatggggatccgggccagtagtgcaagccaagcacagcctgccaggctgagtgggtgcaaggagcccagcgggcacaagcaaaacccagacagaggtgctgccggccacagaggtttctggctggcaaagtgacacccaaggatcccatgacacttacatgcacactttatccattttcctccaatgtatgatttagatcttagcttaaagaaaactttcctcaggaatcatctgttgcgttcaaagttcagtctaagtcagagtaatttcctgtcacaaaagcttattttttgcctttataaataagttgcatccattctttaacatttgctcatttttaaaaatactttattaatgtctatttttatactggattgcatgtaccaagagcgcagttcccatgcctacctgcctatcatagtgaccatggatgacaaggaattagcattctactacaaagagggagactgagatatagtcaccattgttccagggttccaaggaaggcagtaggctctcaaattacccatcgcaaccagggtagatagtgacaaattcttttttttaactgtcttacctggttacccaacacaatccctgggacatagtaagaacataacgagtacttgttgaaaaaaattcaaatgggatgtggaatgcttagaaagagatgtggtaatgacctctaaaactgaagactatataaatgaccaattttagttataaaatttagtttataaaaatatttctcaatcaaataagttaactggcatcactgcctatgaaacagactctctacgcactgacatcctggaagcctctaaagttaaggacaagactctaatctgcagtaacattgctgagggacaagctgaacctttgagagaaagaatctaattatcggagagcacacttttcagaatattacacttcataagctatgtcatctttcagaaactctaagcatatattctgacctgtctttggttttcttcaaaccttttccaaagaagactctaaaggtattttaaagttagagaaatcctaaaatatcatcataatagaatttacagaataaatcaatacatgcagatatatcctattggaagtatttttagagttctaactcagggtgttaagtatgcatctctcttccttattggactaaatggggacttcccttcctactttcccccatctgtacctctttaccaaagacagctggctatcctttttgagcctctggatggcatttcaacagaattttagtgcaatggatgaaggaattgtggtgatgagggatgccagggcgaaggaagagaaggcgtgagatgggcactcaacactaataggttttgaggaataagttaaggatagccagactctgctctaataaaaagcctgctaagatccttctctgagtcctgatgattgtttttcttttaggggatccaaatacctgtttctctttcctgtaattcttctaattacgtctaccagaatccctctcagtccagtattaaacatattaaagtccacagtctctgaagctaccctagaattataatatacccagggtatttgtgttaaatttttttatgtttttatactttatcaatcttttaatactttatgatttctccttactcctccttctgtaccatcttctcgtcctcttcttcttgcttttaaaaagtaaactaggtaagacaagattatatcacttgcaaagaacctaagaatcatctctgtttcaaagtcaaatggaagcagagcattccacgacaattccagccaatagttaaataaagtatagaactcaagcatggattcttttgggactgaaggaactgatgggatggaatcaaagaaaagttatagcaagggctttctctccacttgattccttttaatgctgcccttttagatactagtctagattatcttaaagtcacatgacactacagagctatatagaggcaaaatgagaacatcaaaagaggaaagaagattgaagacaaaagaggaggctggaaggcagtagccattaaaggggtatgcaatcatggacaaatgcagatagagtttaagcaaattagggataatcagtacatttaccgatatttagtagatgtctttgggccaaagaaataaaggcagaaaataaggtgaaaatgaaagcaagtagaaaacaaatacagaagagtataggcccaccatacaaccatctgtgagttctacggactgtttttcaagatgccttaaccacacaagcatcaccttggatgaattatattgaaaagctattcacactgggtcagctaatgatgaaatgggtgctttcaattgttattttaaatggaaatactccatgccttagaaaaatgtctgcatttaaattttttttaaccagtaacctcccttcaacccctgcttcccagccttatttaatattaattgaaattttctggtaaagtattagattttacccatccgcagttagttactattgtatcagaattatggaattctttaaatcacagcacttcagctgattatgagtgtgtgtatattgtacacatattgtattctaagtattttaatatataaattgcattctaaatttttaaaatacttttcaagttatagttcttttaaaggacatatttagtttactaagcaaaataatctgaccttaagttgttcttccaaagcagcagttgcgtgatctccactagattcatcaactaccaccaccatgtgagtgagagaattgaccctgacttgttcttgttctagatcttcttgaagcacctgaaagataaaatgttttaaaggaaattaaaatgatattcttacatgtgtgttgaaatgatttgctctcaaatggtgaaatttatttctgctacatctcaggtactcccattttttattaacctaaaaccattccaagccaattttctgctatgacgctcagcaaaatttatatgttctattgttaatttaactggaaagtatctagagaagacaaatgttaagaaaggtacagcaggatgttctccttctcatcccaccccctttctccctttcaaggacttttttcctacaactatcagcacttctggcattttcaggctcttcttctctactgaacttctccattaccataaaaataaaacaaactcttgatccaacaaaccggtcctcctactgtcctattatgtgttcctcttcactgaaaaaaaaaaaaacaaatgtatcctatagttactgtgcctacatatttatcctactattcactttgcccactaacccattgaaatatcttttgtaaaggacaccatcaactttcatgttcctaaattcaataaccatttgttatagcgtcttacttgacatgttgattactaacctaattggccactccctcattcttgacaccttctcttgattaccctcctacctatgtgctactttttttattttttttttctattttggagacggattctcactgtgtcacccagggtggaatgccaatggcatgatctcggctcactgcaaactccacctaccgggttcaagggattctcctgcctcagcctcccgagtagctgagattacaggtgcacaccaccacgcccagctaattttttgtattttcagttgagacgggatttcaccacgttggccaggctgctctcaaactcctgacctcaggtaatctacccacctcagcctcccaaagtgctgagattacaaacgtgagccactgtgcctggcctatacactactttttagctcctttactcgttttttcccttccgctcaaactacaaatcagatgtcagtccgatttataaaaaccaatagatttctatcatactaagaaagaaaatttaacttctctacctgaaattcttatatgatctagcacctgactacctcaccagtctaattgtataccattctcgccctcacagtgtttcagaatgacttgctttgtctctcttccaaaaatgtgtcaagctgttccctctaccaggattgcttttcttccagatgtttaaatcatttctttatcattcaggactcaatgtaagtgtcacctacctagagcagcttttcatgagcaaactatccaatgttgctccctagtaattcaccatttctgtcatttttttaatcatagtattgtcactactcaataatttcttatgtatcagcttagtccttttgtctctacttactataataggcagtccactagaacagagatgccctctgtccttctcactatgtattacaagcaaataaagatcaataaacatttgtcagataaatggtaccatgtgggggtttggggaaaacatgcacagatgagtttgttccttcctgattgcacaaagattacaatataataggaagaattagtgatttttggtgtaatcacaattacactaacctcaacagaaaataaccacttggtctcaactgaaccctaggataaaaccagaataattcaaatactgcctttctaacttacaaatgtggctctgaaaaaatcatttccccctattaagtgaggctgtcacaaaacagtatttccaatctttttaaaaacatgatgtacaattattttgtaatgatgaacaggggtaaacacaggaataaattaggggtaaacaaaggaggctgctctagaaccaaggtatgttgcctgggtgctccagatcccataagaccttaccctgttacactatttattattgggatttctctgaatagctatttgagacttctaggcaactactttgtttcttagaacattttgttacataacacaagagtggagaaacaagtttgggacatttcccgttactttctggcaaacgtgctgtccctacttgcaaaacaacagtgcttagcacctatcagtctagctcttaggtattcaaactctatggcaggtggaagggaacttattaggatggctgaatcacaatctcaaatgcatgagcatttttatcctaggcttcttattttcgaagcctcaacattttagaacactataaaatcacttctttttacttcgtctctctagattttcatactacattttcaagtgaagcaatttagaataaaatgactatgcatctattttgtgtgtgcaatctatactgcctatcatgcctttgacattccagagcttataatggttaataaaactctttttgccatgaggccaaaaatggaaacattaaaattcagagttgtccttgacagtcatgttgagtctgtgttttctgagttatataagacaggactgggaacattttgaaggtgtcagccgggaatgtttcaaataataattaaaatgataatttggtggccagtgtatcataagttggttttctgaatttagtcaattcttttctgtccttcaatgagtatatataattacatatattacaaaattacaagtaaataatgccagttttcatttttacatgtaaattgctttttcacaattttaatatattttacttaagaagtgtaagaaaaacattggatccatggaatgaatccaactcttattgagtcttttaaagtctatgtgatcaaacgtactatattctccattacttagttgttctgattttgtttcgttcatctatttgttttataattggaaatggcattcttgccatattgatcaagggtttatattttatgcttggcagaagtgctaacgtaaagtaccactaaagagagttgtgagatgatagcattaaaatctaacacaagaaccctctggacttacggtgagtacaaggaaataaaggagtggggaaaggctctctacagtgactaagaacgttgaagagtccagagtgctggagtagatttgcataaggtacatttgatttaatgttatttccagtatctcttctcctctatgactttttaaaattgtatttcttctttctcagctaattaggaattaaactaaaaaaggttaaactgacttttttgagcacactaaatagctgtaagacaaaagctatggtaaaacagtaagcacgtctcctattttctcagacttcaaatgcgaaataaatattagtgaatataactgtattagctaatctccttaatatcagcaaaatacagattatgaactatgcaacgttcagggtttacttttacactgattcttacaagtagcagaaacgccagacataaaaagctggagttaaaaagttcaattgttctgccaaactaggaatccatgaataaaggccttgatcattggggtaaagaatgcctgcctgtttctccagttggaaagaaatgaattctcaagagtatttaaaaaaaataatatgctaaagtgttgtaaggctatatttaattacaattttaaatactgacttcttatggatttcaatttgtcatagatgaatttatacaacggagatttatattggatttgctaattaagcctgaaatatgagccaaatagtttccaaatatagatgcatccctagagaagtacacaaaaatgtttgtctgtcagaaaataataccttcaaattaaaatattgtaatataatattgttaaaatgttttcctttattaaaagcttccagattgtacatacacatacacatatatacacacatactaggtactttattatgcatttattttcattattttattaaaggaatgcttttgtaacacttaccagatttcaaacatctatcatgttcctagttaaatttcattaccattattagatacaaatgttaccaatgtttgttgtcaaatgtcaaataatgtatttttttctttatgacaagagaaaaggccaacagtgagatgtaacattaagaatgcctagattggacaaacagtttttgttatacctctgtgaataattgtatttcttctaaataagtctctagttaaagggcttaacaaaatttgttactcccttagtacatgttcccaattttattatttaaacctgacttttcttgtacttcttttaaatgccatcagtgatactgaattcttctggctcttgtccatgtcaagttggttttcaaaagtggcttagaaaaaccactggagagccacttcagtgtttattctagatctatgctattttaccctttcttagaacacatgtaaaataatacttaggaaataaagacatggaattatgtaaggctagggaaatttttgatttgatgtttaaaggtgaagagcaataattaatcgaaaggcagtataatagaaaacaaaaacaaggatgggtatcctgtaaattcgatgggagaagcttttgttttacttgtctatttcttttggccatagcatagactcagctatggaaagaacaggaaaagaacagctgttacctatatgtaaagttttttttttttttaactactcctccgacttcattgaatacccaacagctaattgccggtacttgcaggtcacacacacacaaacacgcacacgcacacacacacacacacacacacacaaaacacacccctagaaacaacacagaacgctgttcatcatgaattggaaggcaatctattgtctccaaaaatgactttaaaattaatatatttagatgtttaattacaaatattcagtagtttgtagtttatctcaataaatgcacacataaggaaagactaacgagaaaaaaattgtagcaaacataaaatttgcaaaggacattaagaattcagaaggttctaggaatagagttgagtctaacatccaggaaagaagtatcttaaaaaagctgtctcatgaacaaaaaaatccctagatactaatgatcatgttaattcaagacatctggacaggaattgactttttttcaaataaaaacttcaagtacagatcagaaagtgttaggatttcttgggaaatgatggggtggtaggtaatttatttttttcactcttttcctctatgccccattccttctaccacctctacactgggctaggctctatatcccttgctggcctgaatgatatgatctggaaaggactttcgattttatttgcagtgaaatattcactttgctaagcctggctggtcacagtattgtctagctttccatgaagatctatttacggtatataactttgttataaatttgctgaatattttaaataatcttcctcaacaggctaccctagaaaagcttttgatattcacttacttaaatgtgattgaatatctttattagttcttatatcagaacacactgattttatctttttgttagaaatgaatgtttatgtttctgccaactcctaagctaccaaatgggggttctgaaagactgtttcaatggagagatttgaaaggctatacaagcacactaaatgcttctcaatagcctgaaggggactcaataaatacgaaaagaaactgttttaaaaataaagtagacaattaatgtactcctacatatggaaaaggacataggatgaaatagattgaccaaaacttgtgcatgactatgaggagacagtaaaactgtagtcaaaagtgtagcatctgaaatcagattttctatgtgtaattcctggaagcatcaataaccaatcacgtgactttgagaaagtcatcaaccacaccaagcctcagcttcctaatttgtaaaactaagataataaaactgcctatttctttatgtggttaagaagattgaataaggtaaaactgttttgcattttgcctggaaaacaatataaattccaaaaatattagcatctaattagttgaaagaattcatatttagccatatttatatcaaagttttgaaactaaactgcaatgacctaacctaatactaatctattttaccctcatctaatacattctgactatcatcctttctaatagacatcataagtgcaggaagagaatgtgatttttgaaaagtcatgaaaacaagtgaagttacagcaaagttttaaggtctggagaaatatacagtaagtgttaaatccttaaataatacctgaacttccaatttatttacactacattaataaaagtaggttcaaactacctcatctgatggttatcacagaaaaatttgcatgggcagacatatgtcatggagtgaggacagtccctaatcacgaaatggtagccctcaattctcttgcctttcctactctttctacaatccatgcatgcacccacccatacattctgcatatagttacagaattaaaatcagattaaaaaccaataacattgaataaataattataaaatgcctttactgaaaataattattgaaaaagaaaagaagattattgggagagagttggggtggaaagtttcaggcagagcacagaggaaatgctatgcattgtgctgctaacagaatatagttgtgaaattcagttccaatgattatcctcctgctcagacggtattgccattcttatcataagcctatattcctgtttcccttatagtctctttttcctctattttaaagaactacaggagtaatggtgatgaattatttcattaagcattttgattctgagtatttaatgtgtagctaccactactgcttactctatgtttgaagactcatatgcacacagtctctgtaccttctatctagacattcccaatcctgggaatccaaatgccacaacatcttcaaatctctttgtcacttctctgcaactgctctagtctctaggatctcaggtggagtcaagcttcactggaatctcaaaatggagagaaatggtctcaaaggcagacaggtcaaagttaaaatcagaatctaccaattaatactgaagttaccttgaacaactccttaaactctttgaacacatctatttgtctgtaaaatcaagtattaatatccttccaggccagacacttacagaacattctattctaccaccacagaatgtacattattctcatctgcacgtggatcattatcaaaaattgaaaatgtgctaggccacaaggtggttcttaacacatttttaaaaaaatcaaaatcatatcaagcatcttcttgcaccacagtggaaaaaaactagaaatgagtaccaagaagactccttaaatctatacaaatacatggaaattaaacaacctgctcctgaatgatctttggacaatgaaatcaaggaagaaattaaaactttttgaaacaaataaaaagagacatacaacatacctccacctctgggatacagcaaaagcagtcctaagatggaaatttatagcattaactgcctacaccaaaaagatagaaagatctaaaattagcaaactaatattgtacttcaatgaactagaaaaccaagaacaaaccgaaaccaaagctagcagaatataagaaataacaatgatcagagcagaactaaatgaaactgagataataaaagacaaaaaattaaaaaaattagagagttttctttgaaaagataaacaaaattaataggccactagctagattaaccaagaaaaaaacagaagaatcaaataagcaaagtcagagatgatagatgtgacgttacaactgataccatagaaatacgaaagattatcagactactatgggcatctctaggtacacaaattagaaaatctggaggaaatgaataaattcctggatacatatcaactcccaaaattgaaccacaagaagcaaaaatcttggacagaccaataacaaatagtgaaactgaatcagtaataaatatctcccaataaaataaagctcaggaccagacgtattcacagccgaattctaccagacatgcaaagaactggtaccaatcctattgtaactgttgcaaaatatcaaacaagaggaaattctccctaattaattctacgaagccagtatcaccatgataccaaaggcaggtaaggacacaacaaaaaggaaaccacaggccaatatccctgatgaacatagatgcaaaaatcctcaacagaatgctagcaaaccaaacccaaaagcataacaaaaagataatacatgacaataacgtgagctttatgccaggtaggcagggatatatgcagagcaatatctgtgattcaccacataacacaatatatgttttgtgtggtgcaatatatgcagagcaatatatgtgattcaccacataaaaagaattaaaaacaaaaaacatatgatcatctcaatagatgcagaaaaggcatttgataaaatccagcctctccccaagataaagaccctcaacaactaggcattgaaagaacatatctcaaaataacaaaagtcatatatgacaaaccaagagccaacatcatactaaacaggaacatgttgagagcacccccctcccccaagaactacaacaagacaaggatacccattttcactgctccaattcaacatagtactggaagtcctagctagagcaatcaggcaagagaaagaaataaaaggcatccaaattgggaaaaagaaagtcaaatgatttctcttcactgatgataggattttacatctagaaaacccttaagactcctccaaaaggaccctatatttgataaatgacttcagtaaagtttcaggatatgaaatcaatgtacaaaattggtagcatttctatacaccaataatgatcaagctgagaaccaaatcaagaactcaatctcatttacaacaactacaaaaaaaaaaaatacctaggaatgcctttaaacaaaaaagtgaaaggtgtctacaaggagaactacaaaacacccatgaaataaatcatagatgacacaaacaaatggaaaaactttccctgctcatggattgggagcatcaatattgttaaaataaccacactgctcaaagcaatttacagattgaacacagtccttataaattaccaacatcatttttcacagaattagaaaaagatagtaaaatacatagagaatcaaaaaagagcccaaatagtcaaagcaatgctaagcaagaagaataaagttgaaggcatcacattacctgacttcaaattatactaaaaggctacagtaaccaaaacagtatggtactggtataaaaacagatacatatagattgatttaaccaaattaagaacccagatataaaaccacatatctatgaccaacacatctttaacaaagtaaaaaaatgtatatatacactggggaaaggacatcctattcagtaaattgtgctgtaaatattggatagtcataagcagaagaatgaaactgggtcataaatcaccatatacaaaaattaactcaaaatgtattaaagacttaaatgtaagacctgaaaatataaaaatcctaaaagaaaacctaggaaaaactcttctcgacactggcttgggcaaagaatttatgactaagtactcaaaaacaaaagtagacaaatggaacttaattttaaaatcttctgaacagcaaaaacaaacaaacaaaaaaacaaaaaacaatcaacagaatgaacagacaacttatagaatggaaaacaattccgaactatacatctaacaaaaaactaatatctagaatctaaaagtaactcaacaagaagaaaaatagataaccccattaaaaagtaggcaaaggacattagcagacattttttaaaagaagatatacaagtggccaacaaacatatgagaaaatgctcaacatcactaatcatcagagaaatgcaaattaaaaccacaaggagatatgatctcacaccaatcagtatggctattatttgtttttttcaatgtcatttaaaaatttgtgggtacagagtaggtgtatttgtggggtacatgagatgttttgatacaggcatgcaaagtgaaataatcacatcatggagaatttagtatctatcaccttaagcatttgtcctttgtcttacaagcaacctaattatatgctttcacagttattgtaaaatgtacaagttattattgaccatagttactgtatgatatgatcaaatattatgtcttttcattctttctaactgtaatttttgtacccaataaccatccccacctcccttccaccacccttcccagtctctgataaccatccttctactctctatttccatgacttcaattgttttaatttttagatcccacaaataagtcagaacataagagatgtttgtctttctgtgcctggcttatttcacttaacataacgatctctagttccatccacattgttccaaatgacagtatctcatttttttaaggggatacctgtcattaaaaaagtcaaacaacaacaggtgttggcaaggatgtggagaaaagaaaatgtttattcactcttggtgggaatgtaagttaatataaacattatgtaaaacagtatggagatttctcaaagaacttaaaacacaactattggatcctgcaatcctagtactgggtatatactcaacaaaaacaacaaaaagtgttacatgaaaaagctacctgcagttgtatgtttatcatagcactatttacaatagcaaagaatcaacctaagcgtccatcagtaaatgattggataaagaaaatgtgatatgcacatgtatatatgtgtgtatatacgcatatatatatatatatatatacacacacacatacatatatatacacacatatatacacacacaccacagaacactacacagcctaagaaagtatgaaatcctgtcttttgcagttacatgaataggaactataggccattatcctaagtgaagtaacttggaaacagaaacctaaatgcaacatgttctcgcttataagaagaaactaaacaaagggtacacacggacatctagagtggaataatataaactggaaactacaaaagattataggctggtaggggggtgaggggtgaaaaattacctattgagtatagtgttcgctattcagattatggatatactaaaatcccagactccaccactacacgatatatccatgtaacaaacctgcacatgcaccccctcaatctattttaaaacttcttctaagacatgcttattactagagttaaatgagacaatacattaacttcagcttgtacagtgcttagatttggtaggtggtgaggaaatgcttattttctttcatttctgacgtattcacattatccttgcattcttacactgagattcatggaaatagcccttttgagcatcactatttatttctaataacttggtaatcacattatatttccattattaaatatcctcagtgtgccaaaactgtagaccattatgtaaaaatagtttagtgcttttttagtcttactagatatgacttagataaaaatttaattgttaaaggatacagtatcattacttccaatgaataagagagtactaccagatgtaccagtagaaatctactagtattagaaatccactagaaattctgttcataacagaaatattaaacaggatagttctccatattcttcagaaaaagtatcatattcaaccttatattttaacacgggattggatttacggacatgcattttgttataagatacggtcatacatttgataaggaaaattattgccttaaaattcatgttatcatgtgtgtcttagctttcttgtaaggtttccctaaaatgcattttaaaatgttttttataattagtttatctacattattaattttgtattacctatacgaaagaactgaaattgattgttacagtactggttcagagagagagagacattttacatgagactaactcagtaaattagaaatagggtacttatttttttcctttaaacaccattggagaggtcagtgtcttctcatgaggaagtattacaagagtaatgaagtataataactaatgttagtgcctctaagatgacagagtcttgatcaggtataattttcgtagctataccgatatactgtcaaacaaagctgtgacattctaagtaatgttactgaatcaatactcagtaatttctaataaagtaaataataatctgatagctagaaatacttgatttgtaaaataagaatatgggcatggattttatattattattattttaataatctatagcattactgtgcaaatatacccttggaatatgatgcttgttaatagaattcttatgggatattagatgtcttctcaattcgattttaaaaattgtaactgaatatcatgcacatactactacgtagactataaaagtgtgatgttcttttttacataaacttccaatcatttatgtcaaaataatactaccactcaaaccaatttcatagtcaatggtttagcactattaagatatttgcatatgggaatgcaacagagatagaaggaaaaaaggaaagtcagagattgaagacaccagagataacatcaccaggtaagccactttacagatgtatttttctacagctttatgaatttttttttgctgtatgcccaacgttttaattgaaattatcaaactttcatgcccttgtcagaaagttagccatgatggagacgatttggataataaaactagtcaatataatcagaacatgtgttctaaaaacatttactgagcatcaattattgactaagcactctgaaaacacaaaagaaatctggctctctggttataatacagtattttttcagattatagtgtttatcccccttaccatcataaccattaaactttcattaagcacttatgagggcaaaagacaggaaataaaatgaaacttcatagcagaaacaaacaacatgtaattttaaccttgctaaatatgagagtgagtttgctaaccactaaaagcaccacttgatcctatggcactgtcaaacttaactgaatcacttatccttcttccaactattgcatttctctttttcactgcctattttcttaattaccaatctcaagtcccaattgcccagtcccagaatctattactttgagctttttgttcatatcctaaatctagtcctattggttttgatttgatatccagaatgctttgtacctgtttacaatttttgttgtcattgctttcattcaggctctatatactttcagcaatatcctcttaacatgttttccggcctcctgtttctctgctcttttatttatcctcaaaaaatatcttcttaaatattaagataagttttcctaaattgctgctatttctagtttaatttctcatgaataatggtttcctgttactcatagaactactactgcaaatgcctgagtcttttatataagactcatgatcaccctccatgatcaggcttaaatcctccagcattcagtatagtacaagacatcgtaaatgattggtttctgcattcttcacagcacccatgtgctataatgagggtttgttcagtgatatggaatagaatgcaatggaatgaaatgaaatgtcagatcctttggcagaattatacctaatccttctctgtaacatgaacatctagatcattttaaaggtcaccagatgaggatatttcacaatcttggcaacccaaatgtctgcctttaactaaccttcaagaaaaggataggtgactgagtttctaagaggctacttagtttgtattaatcagtatttcacatataaccttcactgaagtcagaatatagagtatatattcacatcggcaaattcttgtaatttgtaaagtctttgttgatgctgtcaccaaggttatgcatctatgcacaaaagtctaaatctctcaaaagaatggaaaacctagctagtaaactcagctttaaacttcatcgcagtctcactgtgccaggagacaaaagatttcactgttaaatattttccttttgaaaaaaatgcctccaaaatggcaaacttctttactattaatgaaagctcaaggcttttcctcctcaatagcatcatgccactccttcgagggaaatcctttcattctttgtcaacatcactaataaattctaccccttaagacaaaaaagaccagctagaattatatgtgatatattttttcacaggggaatgagaggttcgatttgtttactccccagaaagactcactcttgggtgcctcaaagctaaagcaaacctctaaattctctccctacagcaatgtctatgaaggatgagtggtttctcccaaatggtgcagccaattgaacttttcttggttacccagagtaaagagtttggctagatttaatagtaaccaccatataggatcaattgctttaccttacctaattgccaggttcagtaaaagtgacttatcttcctgacatttcacagtgtctgaatttctagcctgcctcataataaaatgctgttgaaatgaagatagcaaaggatcctgtcacagaatatacagaagcatatctgtaatattcacagtgtacttgcaagatttgcaaacattttaatcttgccctccagttgagagagagagagcaggcgacctctgatctgagcagaatttaaatcaattcccagcaataaaatctgtatcttttctttaattttgtcatctgcaatcatctttaagaaaaaatggtgatggcacaaggatttaatgtctatctacacaaagctaaaaataaatattatattaggttagaagtttggtgatgcagcagatgggagttgcttttgtggggactctaaggttactgatgcattttgttgtcagaaggagaaatttccttactttcaatgatttacaattcttgggaaaaaaagctgcaaagcgattcaacgactatataaataaggctttagtttgaactcagttacccaaagaagtaacatttattttcttttgttttatgaagtgtggcaagactaacaaaacagtgttcctttaattctgtatgtatgctccttttagtcttaaaagacaatataatgtacatgtttcaggtttaaataaagtcaactctttgctaaattgtttgatgttaagtcaccttcttctcgccaaaattgttgccaagaaacaaaagagcattatcaatattcaggacttgaatatgaatctttcccttaatttttataaaaaaaaaatctgtcaaatatttcaaaaaatattgtcaaatctgtcaaaaaaaagagtgctcaaatagttaaaagtaggagttggccttactctctgagccagaaaaccaatgccttctggcctctttatgccctttaaataaataaataatgcctggaggtaaaatgttacataatcaacttgcatatactcctgttgccttcttttgtttcacattttttcttcaaggcaatttcatagtcattagaaatggcatactttcaagtaatgaataatatatttaaattttatgacaatatttgtcaaacgttttccatttcattcacattatatctttcagaaaaaactacaaaacatttcaggtacctggcagaatattaagatcctggatagcttgtctcaccttaatgaagagtctgttcagcgtcccaagctaagaacttccttcatagctgccctaggttatccgtacttagctatgctaacattcttcttctactgctcttttggagctcttctccctggatttcgctttacactccaggcatccagcagcagtgtcctgccttctgatgttcagtgttacgtggcctaatcttggccttttctaaaatacttcaacttccaaaagtattggacacatttaaactgtgactggaaggaacactagaaacaaactcactcttttatttccaaagtaaagatacagagaacctgggacattaagtgatgtttggaaaatgacaatttagttagtggtagaactggagctcgaattctggcttctagtgggagaagtttgtcttgggttagattcctccaaaaacacatcctgaacaaaagatttgtgaacaaataaatggtttatttggagggtgaactcgtaaggcattatgagagcacggggacgttcaggaagttaccctgtggatacctggagctcagtcttactggggaatctctgaaagactgtggagaatataccttagaaatgtcccactatgggacaaagattctacaggatttctctatcaacttttactcctcattggctaagggcagctctggtggcactaattccacttcctgtccaccttcaaactggctgaaatggttctgcaccagaaataccctccggtagagagaagccattgctgtacatcaaccttgtccaatccatgacccaggatggctttcaatgtggcccaacacaaatttgtaaactttcttaaaatattttttcaattatttcttttagttcaccagctatcattagtgttagtatattttatgtgtggcccaagacaattcttccaatgtcgcccagggaagccaacgggttggacacccctggtttatatagacactttctgcatgtaacttccagtgtaggccaagggaaagagggcagatatagtgtcaacgagagaagcaaatgtgccacatcggaaaagcggtacggttagagaactagcactgtacctaacttcttcttcaggtgctcaattagtatctatatgacaagtaatcacagttacaatttctacataattgcaatacagttgatgtttttttcctgatggcatagcagacggggattaccatagttacagttcttcttaaatgctagatcttagaggactcctgggggtcaataatagtaagggctggccccatttgtcattcaaaactgaagctcattaaacttaaaaaaaactctagaacttagaaataaatgtatctttcatttgcatggaagaactgtaaagctatatatgactgaatattataaaaagagagaattaagtttgacaaaaggcagatttcgaaggtatgaggtaaaggagcagatattcctattcaaagccataaatccaaaaaccacagatcataagtagagttgccagataaaataaaagacactcagcaaaatgtgaatttcagataaacaatgaacaatttgggacacacactaagaaaattatttgttgtttatctgaaatttacatttaagtaggcttcttttatttgtgtctgctaaatgtggcaaccctaatcctgggacaattacaaaggatcttgtgtgtgtgtgtgtttcctcatgaattgagcaggagcctatttcaacaataaaactcagagctaattgtaatattttatggcacttattaaaataaagcaccctcataattttggataagaaatattattgtagaagtctcaataacagaaacaaaaaaaaatgctttctggcagcgagggagcataactggaaatgtacaagtaaactgaagaaaaaagatggaaatattaacatttaaaaaatgtcatattctatagaaaagcaatgcttcagactctcatttatcatcaagcttggccagcttcaatttactataaattgaatgtaaaattacattaaaaaaaatcgtagccttattatttaaatttgcattacaagtaatccctatgaagtctgtcttccaggaaagcaaatttttaataaatcacataccctgcgttgttctcatccacaaatatgtttgatttcttttccaaatacgaaaagcctagctatgctgtattttttaaaaaaacaacaacaaatgtcttaatccattttgtgctgctgtaacaaaaataactgagaatgaggtaatttaggaagaatgtacctttattttttcacagttctcgagtttgggaaatccaagatcaagatgttagcatctggtgagggccttttcacagagttttcacatggtggtgcatggtggagggtcaagagataggagaacactgtgtgaagcctcttttatatgggacttgatcctattcttaagggaggagccctgatggattattcacccttaaatattccatctcctaatacaatcacctgaattttggaggggacttattcaagccattgcaacaaagattgcaaaaacaattaggtaaaaataatttttaaaatatggctgactttaagttttaattctctcccatcaaccatgtcatctgtgttactgtgtataggtactatacacagagtttgctttctagtagaaagcacgcaacataagatacacctaccttatgttgttgtacttggcgttttaggtcttcaagatcaggtccaagaggctcttcctccattttccttgttctttcttctgtttttgttagccagtcattcaactctttcagtttctgattctggagatccattaaaactctatgtaaactgaaaatttgaaagaagcctattatgacctctttgaaagcaacttattactgaacatcacaatgtaaaacaatagaatttataatatatggaatgttcgcatttgggggcatctattggacattgagaaggatgtaagtaaagcccactatcagtcaccccggaactattatttctcagacttataatagttcacaaatcctgatttctaaaaactttcacatagtcaactaaatgtgaacatgctaactgaagtgcaaagcatctgataattgactaagtagtatattttggcagttgttcgtttacattctcattatttagtatgtgtggtggttaaagatggccacaaattctttgtcacttttcccttcaagagatgaggtctattttccatccctgtgaatatgatctggacttgtgtttttttttttgaccacagaatgtggcataactgacaccacaccaattccaagtgtaggctataaaagaactggcagcatttgtatttcttcctctcttgaagcctagattccatgctgtaaaggaggccaggctacactaccgaatcattagagaccatataggagtgattctgcaggataaaatactgtattagaagtgagcttccagctcagcacagcccaaggggtgacccccagctataaaactagtaatataaaaacaacctggctgagccctgcttatattctcggtcttcagatcatgacgcaattataaattgttttaacccattaagtttggacgtcatttgatacacacaaatagactagagaaagggtgctttttccccacaaagatatagaaaatagtgggctgggtaatgaatttaaagtccaaaggcctaggttcacagcccagcggtaagctctacaaccaggttcttaaacgttctcaattacatttccagcatcagggacatgggataatgttttgcctattaattacacaactttatgttgaggatgaaaacacattattgttcattcattaattcaaccaaaatttgagatgcaaatgagaagtgctgatggttattttaaaggaaatactctttataaacatcatgtttaaagcatttttcaaaactatattctgaacattgatcttataatttgaattaggaatatgttattttgaatacataattttactctaaaatctttactggaagtttccattaatcatcacatttaaacacacaaagtgcacacatagctgagagtgttttttaacagatttaattttttggctgttttagattcacgaaaaattaatgagattataatacaaagagttatcatataacttgcactcagtctcccgttttattaacatcttatgttattatggaacatctcttacaattaatgaaccaatatttgtgcattagctggagactattattatattctgatttccttaaactattttttgtatttcagtatctctccaaggattccatattacactcaattgtcctgtttccttaatctgcttttggctatgacagtttctcagaatttttctggcagtttttaaaagtgctggccaggctggtattttgtagtatgcctctcagtggggatttgtctgattttttttcctcataattaaactggggtttttgaaagaccacagaagtaatgggccattttaagcacattttataaagcatatataccctcaacgtgacttatcaatgttaaatgtgaccacctggctaaagtaataggtgtcatgtttatccactataaagttactctttccccctcttttcacactgttttttaataagaaagtcactatacacagcccctgtggagtggggagttacattccctctccgtgagggcagagaagttacataagtttttggagttttttctgcattggagatttgtctctattcctccatttatttatgaaattatttatttacatagcatggactcatgtatagttatttgatactttgggctaaatccaatactagtttttgctttggatttttgctcaaatagttccagctttggacattgggaagtctcttagttggcttctttgacacatcccatcagtgttttttgtttagagcgagaccgtggagtttagcatgttcttactatctggcactaccaaatgttccaggctcattttctatattccctttcctagtgttagaatcagctgtttctccacagtgttctggttcctttttttttttttttttttttttttctttaaagaatgttactgaaacccaagatcctgttgctaggtatgctccttgcttctagggtgttgtagcttacaggacctctgggttgacataaagaagtggatgtgtgagtgtgtactcacccataaatacttctatatataattatctcatctgtattaacctaatattaatttatccatctctctccaccttgtgacttctgttccttatctgtgaactacctcttcaacttttttttgaactacctcttcaacattttgagttataagaaactcaaaaatgatttctttaaactagaagttgagatgaccgctgttcatgtttggctcctcatgctgctgaatccacagacagagaaaggggttaccatacagaacctaagcacaaatggtcaactgagttcacccaatacaatgcggggcaagtagtactacattagaaaactatgggcatttgccaggagtctcttagtatacccatatatgatagtgttaaccaataaaaaaaacagaagatactcgatcaatatggaaacactaataatatggttctttggaaggatgttttttatttcccactaaggtcaaagtacgcaactagaagaaattctgccatagtaaccaagacagcattgtattagcataaaaactgatcagtggaacataatagagaacccaggaataaattaatgcatttgcattcaactgattttggacatgggtgtcaagaacacaccgtgaggacaggacaccctcttcagcaaatgctaccaggaaaagtaagaatctacatgcagaagaatgaaattagacccttatcccttgccacatacaaaaaccaatttgaaatggattaaaaacttaaatttaagactcaaaactctcaatctattagtagaaaacatagaggacaagcttcatcacaattatttgggcaataacttttgaatatgactgtaaaagcacaagcaacaaaagcaaaaatagactgaggacttataccaaactaaaaatttctgcacagcaaaaaaattaaaattaaaattaaaaattaacagagtaaagagatatccaatagaatgagaaaaatatttgcaaactatatatctgatgggggttcatataaaaatatggaagaaattcaaccaactccatagcaagaaaacaaataacctgattaaaaataggcaaaagaccaaaatagacatttatcataaaagggacaaatggataacacagatatgaaaaaatgctcaacagcactaatcatctgggaaatgcaaattaaaaccacaatgaggtatcagcttacttgcaaagaaaagggaacacttatacactgtttgtgggagtgtaaattatttcaactattgttgaaaacagtgtggtgattccacaaagacctcaaaacagaactaccattggacccagcaatcctattattgtgtatacacttaaaggaatataaatcattctaccaaaaagacacatgcacacatatgttcgtggcagcactattcacaatcacaaagacaatcaacctaaatgcttatcagtggtaaactggataaagaaaatgtggtaaacacataccatggaatactatgcggccatgaaaaagagtaagattatgttctttgcagaaacgtagatgaagctggaggccattatccttagcaaaataacgcagaaacagaaaaccaaatacaccacgttctcacttataagtgggagctaaatgatgagaacacatgggcacatagagggaaacaacagacatggggcctattggagtttggagggtggcagaaggaaagaattaggaaaaaataactaatgagtactaagcttatacctggtgatgaaataatctgtacaataaacttccatgacacaagtttacccatgtaacaaaactgcacatgtacccttgcacctaaaagttaaaatataatagtaattaacgatatctttgtcaaaagaaaaaagaagagattatcacctcacttttgttagcatggctactatccaaaacaaaaaaagataaatgttgataacgatttaggaaaaaggcatgtattacgtacctgcaaaagttaaaaattactaattaaaaaaaagaaaacctttacacactgtaaatgggaatggcaatcagtacaggcatcatggaaaacagtatgaaggctccttgaaatatgaacaacaaaactacaatatgatacaaaatcccactatgaattatatatacaaaggaaatgaaatcagtatgtcaaagaaatatctgcactaccatttttattgcagcactattcatggccaagatatggaatcaatccaaatatccaccaacatatgaacggataaagaaaatgtggtatacatatatacaatggaatactattcagccataaaaaagaataaaatactgtcatttgcaacaacatggatgaacctggaggatattatgttaagtgaaataagccagtaaagaaagaaaaccactgcctaatttcacttatatgtggaatctaaaagagctgatcccacagaagtagggaatgaatagtggttaccagaggctgaggtggttatggggaagggggaggtatggagatacttttcaagggatatatagtcacagtcaaaatattcaagtgatgtattttacagcatggtgactacagctaatgaaaatatactcttgaaaaatgtagagagagaggacgttaaatattcccaccataaaaatgataaatatgtaaggtaatgcatatgttaattagctagattcaactgttccacaatatatatttactcagaagcatcacgttgtacatgatgaatatacaattttatctgtcaatttaaagtagggtttaaaaagcaatgtttagaaattgatagcatttcaaacaataaaatataaaagttgggtctgttgagtgtgtgtgtggatgctgcatactattggcaggaaagatagaacacactcaaatatgtttcgctcagtagactacttacacatttatgtgaagggtcgggggaaaaataataaacgatagtgaaggagccaggacctaacaacaaagacaactgacctagcatccccggaactggaagaaaaaaggaagagagctgttgccggagctcagtgagaattagagacatggaacaagagctgtccaacagtagctgtagtttaagaggaacacaattccagccactccacagtaagaaacagaagaggaagagaaaagtaccacaatctctgctttcaccctcttgccagtgcctcccattggctgaagtactttagcaaccaaaggccaagaggaacctgggtaacagaaaatctagacttcatcctctttgaacagagcaagaaggagaaaagtgaaatgaatctgctaaacagagtaactatcaaaatacttaaattagtataagtgtatttaaaacaaaaggatacaaaattccatcagcatctttatcctcatacactaatgccaggctatttaaaccccaacatggaacctgtatgtaatgttacataccactcacactcttcatataaaattacagggaaacaggggaagtaaaccagtaaaataaaatataaaagataatggctccatagctggtccgaagtattggggttgttatcagagctttcttccaatatgcatttcatattccttttgagagtgtttacaataatttagattgcactatttattgacttttaacattttagagacacatttaccatgaggaacattgcaatcagaagttatgagaataaactttcatttatcaaacacaaaaagtagacattttatttttatgagaaacaacagagatgagatatccatttaagtggaagcaaaaactgaaagttgctagtatttgaaagcatcatttactttttgcttttggacagacatttccttcaacaaatctttactgagtttcatatctatgcaggaaactcatatttgttaggaatggacaaaatacctatcttcaatttcaagtagcttagagactattagagacataaatacaaaaataattagaatataagaaatccattataattagatttatatacattcctgagggagtaaggagaggatacaaattgacctgcagtcattgggaacagtgtcctcgcagaacacacagcctaagagttgagacttgaaaaattcattcattaatttacgaaatatacaattattgagtacctggatactacggatggagaggcaaggaagaccaacacagccccttgctatcttggagtttatatggatggcgggtgagggccacagataatacatatagctcaacaggccattagttggttataatgtgatcatactatgaaatgagagcaattgaattgagtctgtaaaggggggcctttagtgcagtactggacaactgtgaagactgaagtcagaagtagtgaaaaagaaggtataaactctttctagacggaaagaaagacctgtgaaaggccctgtcacatcacagaggaaccggaaatccagtgcagcttgatcgcacaaggtgcaggatggttgtacagtatcatagcctaccttaatctgtgggtccacagagatttcttgagctctgccccaaatctgaaatttgaacacccagtaatctttcatgttctatcgtggtttcattttacaaacttggactcagagattgaccaataagaagagatgtacacataagtgttttatcttctttttttttttttctcttaatagagacaaggtctcattatgttgcccaggctggtcttcaactccttagctcaagcaatcctctccccttggcctcccaaaagtgctgggattataggcgcgagtccccgaacccagccaggtgttttctctttataagtgggatacagaaacatctggttggggatttttggggtagggaccagaatggctgggtgtgtgcaaacgggatggctcaatattttaatgactggtacagtcacatcaatgtctcccagccaaatagagccctgctttttctctcttcattagtggttctgaaagtgtggttactggaccctggaccaacagcatcagcccatcccctagaaacttgctagaagtgcaaattcaaaacttgctagaagtgtgtgcaagactcacacttactgaatcagaaactctgggatgaggtctagaaatgtgtattttaacaggacttccaggtgactgatgcatactcacacttgaaaattactgctctaggtaactttattctacaaacacaactcacccaaattctgcagagaccaagatattaacattaataggaggacaactgccaatccccaggagattactatgaattattttgacatgagacttttacattctcttcctgacttcacctccacttacagagagaagtgtgactgccaactgccaaagaatgggttctacctgaggctccaaaaagcaggatttcatgtgtctgaagcatgaaattaacctcagaacaagtttgaaaacagaagaacctaaggattgtggaggtgtgatactaataagcacgaaaacaaaaagcattcatcccattgttggaaaggattctgagatgttttaattgagaaaatatttcttttccttactacaggccttgactagatattagcaaatagtagtccatatgctggatttggtctcatactaattgaaaataaattgaaatttttgccagtagttaaaatttgagatattagctacaaatatcaaatctgaccactcttgatcatatttaataggattcagcaaccctaaaccttccttcctataggacaaaattgagtatcaattatacttcacatccaattatacttcgcatccaattatacttcatatacaaagtataagctctccagtttgctgtagtcctcatcactccctatccttttttatacgcaactcatctcacttccttatgttatgtttctggcttctacaataggcatttggatttggtgccccccggggtcttgatcacagcttctcaaacttaaatatggatacagcccacctggtgattctgatttaaattcacggggttgggtcgaagaattcagttctaaccagcttccaggtgaaaccaatgttgctgggtcatggatcacactttgaatgacaacattccaggtaagaatattatttatttgaaaaccactgctagtctacttaaggtatgtgttcgatctattagttactactgctaaaactcagaagatatagatttatgtgacactggcagggaagtatcaaagggtatcagactcagaatgcccaagtatgcccttcagtaaagtaaggaagggctttattacagtactgatatgtgaaaaactctaaagattgaaataactagtaatgaagaggacgcttccttccttcactgaggcctgtgaaaagagcatcagtaaagtgcaggtgaattataggccagagttttctgggtgattagcaaggaagtgagtagtggtccattgcaaggctgaaccagaggaagaagcaaaattgaaggaggcactgatatcagaaggtgagtttaacagccttcatgacacaaatgtcctttttcccaaagatggtttaaataaaggggtgacttcagggagtggggaggttaacctctgggttaaaatgtcattaatattagttgtaaaatacactggctaacatttattcaactttttttaacataaccttgccaaggtaaagatttataatactagtatttttttttttttttttgagacagggtctcattctgttacccaggctcgagtacagtgacacaatcataactcactgaagccttgacctcccaggcccaaatgatcctcctgcctcagcctcctgagtagctgagactacaggtgcaccaccttccctggcaaatttttaactctttttgtatagatgtggtctccctatgttgcccaggctagtcttgaactcctggtctccagctatcctcctgcctcgacctcccaaagttctgggattacaggcgtgagccaccgcacctagctactgttattttatttctgaggatagtggtaggttaaagagctggcacagtggcatgtgaagccagtatagaaatcacaaaccctgtgtgacccaagactgtgcactattttatttttttcatgggcaaaatattgtattagatcatatgaaatttctgatatttcaatttctttgttgatgaaaatggcttcatatagttcaatttaaaacatgatgaaaatgagacaggagtttcttatttccagctaacattctaaagatgtaaataaatttggaaaaattgtcaaagtcacaaaataaaaatctaccatgcacagataggaaaaaatgtttgcatttttccaggtttcattttatatccttcaagtcgtcatttagacgggaaagtaaaagcaaaaggtgaatggagtatacatatatgactggcaatagagagccgagggagtggaattagaataaagtagtatagggcaggagttggtcctgacagtaggtataggcaaaagcatatcaggacatgatactaggaactgctacggtaaacttccaatcgttcagatcatctgagaatagagaggggctagcaaaacagataagttgtaagaacttggaactttggcaacatagagttacagacctaatggtctctagcgtcaacgacatttttgatatattgttagataacagacatccttatgattgtgcccagtgtttctcaaactttaatgtacatatgaatcacctggagagtgtcaaactatgcattctaagtcagtaggcctgggttggggcctgagattctgcatttctaacaactgcccaagggatatcaatgcttcggatccattaatcacattttaaggagcaatggtataagtcactttgagttggcctttttgtcatttgcagtaaatggcattctaagacgtagtatttttcaaatgattttactcgagagctgtcatcccacccccggacatgaaaacgtatctgtatgaacataaaggaattcaatgggaatgccagctttgctttacagaaactctgttagaatgtaggaaggcggctgggtgcgatggctcacgcctgtaatctcatcactttgggaggctgaggcggcggatcacaaggtcaggagttcgaaagcatcctggccaacatggtgaaaccccatctccactaaaaatacaaaaattagccgggagtggtggcacatgcctgtagtcccagctactcaggaggctgaggcaggacaattgcttgaacccgggaggcggaggttgcagtgagctgagttcgcaccattagactccagcctgagtgacagagtgaaacgccgtttcaaaaaacaaaaaagaaagaatgtaggaaggcaattattctttaaccagtgttgtccagaacttactaaaatgatgtaaatattctatgtgtgcactataggtatacatatataatggacactagtcaggtgggaataatgaacacttgaaatatgtatggctagtaaggctcagaaactgaatttttaactatatttaattataataattataatttacctacacatagctagcggctgcaatattggacagcacagctataaaccgacagataattagattaccaatatccgtgaatccttatttgcaagtacttatccataccaatttattttgtcctccaatgtctatgaggaatgacatcctaagtttagcaatctagcaataaacattaatagcattttttaaaattttcattttccatatacaaatttataaatgcaaaatagtacatgttttcattaatttcagcctgtatttgatggtcctaatagcattttttgtgctttatggaaatacattataaaatgtataaacatatattatgaaaacataatcatatgctaggcactaactaataaaggcataaatggatagactttataaaacctagaggactacaattaaaacttacaaattaccaagaggtgtgagctctttaggaagacaggctctcaggcccaattccctagaattcacagttactggcatatatgcaatcctcaatttaaaaaaatacacctaataaaaggaggtaatgtattataatgaaagtctagattagaaaagaactaccagtgatgttcaattgacatgtcttacatgtaaaatacaattacatgatttaagtcagaaataaaacctgtataatatgatttaagggaaagataccagtacaaattagagaaacttaatttttaatgcatgtttttacttttaaatgcacgccatttagaaactaaaattgtactgatgaaaattggaattgatttatttacttattcaaaatgatggctcaggctgggcacagtggctcaggcctgtaatcccagcattttgggaggccgaggtggctggatcacctgaggtcaggagttcaagaccagcctggccaatagaaaccccatctctactaaaaatacaaaaattagctgggcgtggtggcaagcactttttaatcccggctactcaggaggctgaggcaggagaatcacttgaacccggggggacagaggttgcagtgagctgagatcacaccacttcactccagcctgggtgaaagaacaaaactccgtcttaaaaaaatagataaaaataacaaaacgatggctcaaaaattctagcaaggtggttcttatagatagattagttttggttttagcttaacaattctttatatgcaactagatgcttctagaatgctgtcatctgcttaaataagtaatttttaaaatcaactttgtttcagcttttgtttcattctctattaagaaaggtattgggggctggggaaggaatagcattaggagaaatacctaatgtaaatgagctgatgggtgcagcaaaccaacatggcacatgtatacctatgtatcaaacctgcgagttgtgcacatgcatcctagaaattaaagtataataataataataaaagagggagagaaaaaagaaaagaaatccaagataggttaaaaaacagaaagttattaattgaggtaatgtttaagtccggcttttattcaaactatcacagataggtgaattagtggaatttatataaataatgccttaatataaaaaggtactaattgattagaatcactgagagaacttttcaaaatgacgtcccagccccattccccaacaattcaatcagaatatctgggaatggagcccaggtattggttctgtaaaaaactatccaaccaggtaattcgaatgaacatccagggttgagaacgattgtgcctcttccccgcccccccccccgccccaggacacagccataatttttactttagcccttgggtcctcacaagtggcaaatacctggaaagctgtatccagacaacatgacttgttagggttaacatgaaccagatgcacagaggtaacatggagacaaaggatcaggatgcacaaacatgcgtttacttatttataaatgacttccacaagtactaaaatatctattatgtacccccagaaattacaaataaaaaagaagacttactaaagagtaattttgatcttgtagaatttggggcttttaaatataatttttaaatacaaaataataattgtgtgtcagaaaaaaagaggtattattgtaattaatcctattgattcagcaactgatattagccccaatttacaggtggggaaacaaaggcttacttgggtcaaaacgcaaacaagggaaggtgacaaagtgggaactcaggtagtttggctccggggcctgcttcacaatcatgcaatattgcctgaactaaaattaactttttagagattaactttatatctattataaagtcatttatggcactgattataaatattaaaaaaatagaaaacagaagttcatttggtggaattttatacagagattgtcattaataattttattattttcaccaaaacgaaaattacagttgttactcttgagacaattgttcttagcatgatgtttactttaatgatagaaaccacaataccctattttttaaatttttatttttttgggtatatagtatgtgtttatatttatgggatacaagagacatattcatacaggcatacaggcataatatgacattagggttaatagggtatccatcacctcgagcacttatcatttctttatgtgacaaacattccaattatactttttgttattttaaaacgtacaacaaattatgtttgacagtaatcatcctgtcgtgctatcaaatactacatcacattcattcaatctaactatatttttgtacccattaatgatccccactgcccccgacccactagcattcccatcctctggtaaccatcattctagtctctatctccatgagttcagttgttttaatttttttttttttttttttttttttttttttttttttaagctctcacaagtaagtgagaacatgcaaagtttgtttttctgtgccgggcttattttaatcaacataacgtcctccagttccatccatgttgttgtaagtgactggatctcattctttcttagtcaagcttaagacttgtcatttttgtcaaccctttcaaaaaaaccttctttttgttttgttgatcttttgtatcattttgttgtactttaatgtatttcagctctgttccttactgtaatatttattttctcatactaattttgggtttggtttgctccttcttttctagctctttaaggtgtatcattcaattatttgaaagttcttctgcttttttgatgtaggtatttatacctataaactttcctcatagtactgctttcactgcttcccataggttttggttacattgcgtttcctttttcattcgtttcaagaaattctatagtttccttcttaacttcttctttgacccactgataattcaagagcatattgtttaatttccatgtgtctctatagtttccaaaattcttcctactgatatcttgatatattcagttgtgatcagaaaagctaatttatgttattttgatttttgaattttctaagacttgtttcgtggcagaacatatggcttgtccttgaaaattatccatgtgctgagaagaagaatatgtactctgcagctgttggataaaatgttctgtaaatatctattagttcaaattggtctacactgcataataagtctgatgtttctttgttgattttatgtctggatgatctatctggccactgctgaaaatggggaattgaaatcaccggctattactgttttggggtctatctctctaactctaataatatttgatttatacgtctgggtgttccaatgttgggtacatatttatttacaattgttatgtcctcttgctgaattgacccctttatcattctacaatgaccggcgttgtccctttttatagtttttgtcttgaaacctattttgtctgataaaagaatagctaatcctgttcttttttggtttcgattggcatggaatacttgttccatccctttattttcagtctatctttatctttattggtcaagtgtgtttcttgtaagtaacagattattgtgtcttgtatattcttttatccattctgtcactcaatgtatttagattggatagtttagtcaatttacattccatgttatcattggtacgttaaggacttaaacacttcccattttgctatttcctttctggttgttttgtggccttctcttcattctctctttccttcctgtcttactattaatgaaagtaattttctctggtcatatgttatacattcttattaatttttatgtacctgagtacattatttgatttgtggtaactatgaggtttgtaaagaataagttataatccattatttgaaattcatgacaacactggttgcataaacaaataagcaaagagaaaactaaaaaaaaaaaaaatgctacactttaacttcatccccccactctttttgttgtttctatttatatcttattatagtgtctatgtcttgaaaagttgttgcagttatttttgataggttcgtcttttagtctttttactcaagatatgggtagttgagacatcataatcacagtgttataatattctctttgtaacagaatagtaacaaaccttactatcaccagtgagttttgttacttcagatgatgactcattgctcattaacatccttttctttaagattgaagaacgccctttaccatttcttgtagaaaaggtttggtgttaatgaaatctgtcagcttttctttgtcttagaaagtcttcatttctccttcaagtatgaagaggattttcatagatatactattctagaataaaagtcttttccttcagcactttaaatgtatcatgccactctcctggcctggaagttttccactgaaaattgtgctgccagacatactggagctatttctatgtgatttttttttttatatgattaccgcttttaagatcttttctttatccttgacctttggaagtttgatttttaaatgccctgaggtagtcttatttatattatatctccttggtgttctattatcttcttgtacttgaattttaatctctctctctaggtgggggaagttctgtgttattaccctcttcaataaactttttaggacttttttgtctcctctgactgtatttacaaatagcttgtcttcaagctaattctttctcctgcttgatcaattcttctgttactcgtctctgacgcattcttcagtatgtcagttaaatctttcaactccagaatttttgttcgattctttttatttcaatccctttgttaaatttatgtgtaggattctgaattccttctctgtactatcttggattttattgagcatcctcaaatcagccatttggaattctctgtctgaaaggtcacatatctgtctctccaagattggtcagcgatgccttatttagttcagttggtgagatcatgttttcttggatggtcttgatgcttccggatgttcatcaatgtctgggcattgaagactttggtatttattgtagtctttgcagtatcggcttgtttgtatccatacttctcaggagggctttccaggtatttaaaggttcttgggtgttgtgatttattcctttggtcactgcagccatatatgcactggggtgcacccaagcccagtaatgctgtgactcttgcagactgttaaacgtactgccttggtgatctttgggaagattcaggaaaatcccctgtattacctggtagataatctttttctctttccttcccctcaacaaagagagtctctctctgtgatgagctgcctggagctaaaggagaggtgacacaagcacccctgtagctaccacgactaggattgtgttgggtcactcctaaagccagtacaacactgggtcttgatcaaggcccacactgaccactgactggctatcacctacattcactcagggcccaaggactctacaatcggcaggtggcaaatccaatgaagcttgtgtttttcacttcagggtagcaatttttccctggtgggtttgcaagatcctatatgtaagccagggcctggggtcatgtattaggccattctcacaatgctataaagaaatatctgatactgggtaatttatgaagaaaagaggcttaaatggctcatggttctgcaggttgtccctgagacatgatgctggcatctgctctgcttctgcggaggcctcaggagatttacaatcatggcaaattgcgaaggaggagcagtcatgtcacacggccagggaagaggtgagtgggagggtaccacacacttttaaccaactggatctgacaagaattcacccactatcatgaaaacagcactaagaggatagtgctaaaccattcatgagaaattcaacgccatgattcattcggctcccacccaggccccacctctgacagtgaggattgtaattcaatgtgagatctgggcaagaacatacatccaaaccatactattccatcctggcccctcccaaatctcaagtccttctcacatttaaacatacaatcatgtcttccaaacagtcccccaaggtctttacttattccagaattaactcaaaagtccggagtctcatctgagacaaggtaagtttcttctacctatgagcccgtaaaatcaaaaaccaattagttacttccaagatacaatgggattataagcattgagtcaacactcctattccaaaagggtgaaattggtcaaaagaaaggtctcatgcaagtctgaaacccagcagggtagtcattaaatcttaaaactccaaaattatctgctttgactccatgtcctacatccagggtaaactggtgggagtggtgtgctcccaaggccttgggcagactccaactttgtggctttctagggttcagcttccaaagctgctcttatggtctggtgctgagtgtgtgtttcatttccagatacaagggtcaagctgtcagtggatctaccattctggagtctggaggacagtggccctcttcttacaggtccactaggcaatgccccagtggggactacgtgtgggggatcaaagcccacattttccctctgcattgccccaggagaagttctctgtgagggttctgcccctggagcaggcttctgcctggaaacccaggcttttccatacaacctctaaaatctagatggatgttcccaagcctcaactcttgcactctgtgcacctgcaggcttatggcttgtacccgctggagctgtggcccaagctgtacttgggccactctgagccacagctggagctacagtggccaggacgctgggtgcgggggggaggggttggggcgggggcacagtgtacgaggttgaacagggcagctgggaccctgggcctggcccaggaaaccattctgtcctcttaggcctccggatctataatgggaggggctgccttttagatctctgaaatgccttccaggcctttttccccattgtcttggctatcagcacttgccttctttgtaggtatacaaatttttctagcaagtggttgctcagaagccttcttgagttctcctgaaaatgggcttttattttctaccacatatccatgttgcaaattttgaaaacctttatggtctgctttccttttaaatatacatgtataaatatgtaaaaaacctgcacgttctgcacatgtatctcagaacttaaagtacaataaaataaaataataaatattccatcttatttctttgctcctgcatcagagagtaggttgttagaagtggccacacaacgtcttgaacattttgctgcttagaaattcattccgtcagacacacgagatcatcactctcaagttcaaactttcacagatatctagagcatggacataatacagccaacttctttgctaagggataacaaacatgtcatttactccagttgccaataagttcattctttccatctgagacctcgacagcttggacttcactgtgcatatcagtatcagcactttggtaacaatcatttaaccagtctctaagacattccaaattttccctcatctgtcttcttctgagccctccaaactcatccaacttctgtctgttacccaatttcaaagcagcttctacattttcaagtatcttgacagcaaagccccacttcttggtaacaattttctgtactaggccactctcgcattgctatcaagaaatacctgagactgagtaatttataaagaaaagacgcttaattggctcacagttctacaggctgtacaggaaatatgatgctggcatctgctcagctgctggggaggcctcaggaaacttacaattatggcagaaggtgaaggaggaacaggtacatcacatggccacagcaggagcaagagtgagagggagggtgccacgcttttaaacaaccagatcttgcaagaatttactcactattgcaaggacagtagcaaccaattatgaaaaatttgcccccatgatccaatgagctcccactaggccctacctcaaacactgcagattactacaattcaacgtgagatttgagcaggcacacatgtccaaactatatcaactcaagaacctaagaaatctacctggtgctctattctactgtggctaagctggcaccccacccaaaagataaagtccttccctctcttctctcccctttccacaaacagagatgtctctcctcatggccacgacgactactgaaccaaagagagtactgtctgaggtccaatgttcactcaagggccaaggccactttggccagcctgtggtgaatgctgtcagtcctgagtctctcccttcagggcagtaagaaaatggaatccaggagccaaactctggaatcagggaccctaggagcccacttgatgctctgccccactgtggtcaaactggaacccaagctgcaagccaaagtcccctttactctcacctctcctttcctgaagcagaaggattctctccctgtagccaccacagctgggaatgtactgggtcacacctgaaaccatcacagctctgagtctcacccaatacccacagcaagtactgcctggctacagctgctgattattcagggccctaggtccctttggtcagcatgtcatgaattctgccaggacggggtccttctcttcaaggtgacaggctctcttctggcccagggtgtgttcagaaatgttatctgtgagctagggcctggaatggggacctcaagactctgcctggtgccctatcctattgtatgtctgagctggtatccaagcagcaagacaaagttctctttcttgtctcctctcttcttcataagcggaaggaaggagtctttcctggagctgtgagctgtgctgcctggggttgggggaagggaagcacaagcagtcccttagctgccccagcggatgtctcactaggttgtatgtatcccaagtccactgactctgagcccggcacagcaccaggacttgcaaaggaactgcagtccttgtggcctagactacctttgaagtttatttagaaccacagagcactctaatccatgatgacaaggcttgccggaactcaggttccaaacactgggatggatgattcttccctgtctagggttcatctaaatgctccctctgcgggatttggctgagttctgttctttgtcggtttccactgtgacagggcagcactgattttcaatgcaaagtcctataatcactgcaatctcccttctgcaagcacatagactctctcttcatgccatgtgactgctgccatggatgagggagagctggtataggtgatagaatattgcctttactaccctcttctgtgcctctttctgtgatacaacccaaaaaccaggtactacgatcatgcacctaatttttcactcttatgaaggtgcttttctagtgtggacagttgttcaatttgatgttcctgcaacagggataattactggaggcttctgtttggcgatttttctccacctcctccacaataaacttcgagactcattttccctcaaatatatggtgaccatataaaatgactagatatttttaaaatgtatggtgtatcattaaatataggaatcagaaatcatgatatattataatccaagaaatggcaaacatgttttaatatagaaaagcaacattcatttaaaagaaaagcttgagtagtgcatgtacaaacatatgcacatagttttttgttgttgttgcatggcaataatgaatggtccataggaagcatattagtatttttcaactcccaagatttataacgtttatcaaagttcaataagtggcctgtgaaatataagctttaaagccagaatccaaacagaaccaattaccccctcaaatgtgtaagacttcagctgtcactgttttcactatctcatcacctttaccacaagtacatccatcgctattgtcctctagttctcatgctaactttctgaatgggtaccctcagcatctgtgaagctgtagaaaccctactggcctagtttacctacttgcctcagtaactagatctgctttcctccaaattctggtattccttactagactcagctgcaaagcctgacactgcatggtgtcacggtgtgtataaatcttaggcactaatatagtagtttccattggagaatgaagtgaggcaaggtctgacaaaattatacagtttttatccccctaaaactaatgtgttcattctcctctttacagcaccttctttcccaacacgaagtatgctgacatcttgggctaggaaagaagccaaggagagcatgtcatgtatcattttcaaaaattcccactaattgccatagttattatactgcaccctgcaacctgatcttggaggtcaaactttaaattacaacctcacagtaaatagttcagaaagaacctaatataaagttccccatccaacaactagaaatgaaggaaaatgttccagtttttcacaaaattaaacatgcactaacatttattttcctacttaatggaatgtgagaaatagtattgtttttatactgaattctatgagaaaatcgaaaatgtgtcattgttttcaaatcctgatccatttttgtcctccatccatatagctgaacagtttaattattaatatttttcaactatccgaggcaacattaaagttcaaatgcaaacacatttattttcattttgaaaacataaattcagtttagtaacaataacataaagaagctgcgtggctggatgcaaaagattcttggccaggcgtggtggctcatgcctgtaatcccagcactgaggctgaggaggctaaggcaggtggatcacgaggtcaggaggtcgagaccatcctgaataacatggtgaaaccccgtctctactaaaaatacaaaaagttagccgagcgtggtggcgggcacctgtagtcccaactactggggaggctgaaccaggagaatggcgtgaacccggggggcggagcttgcagtgagccgagatagcgccactgcactccagcctgggagacagggagactctgtctcaaaaaaaaaagaaaaagaaaaagaaaaagattcttgtggcaaatacattatggcaaccctcaaatcaatcttcctgattaaatgcttttaaagaaaataaagaaattggcagatgtcatcaggagccaaggacaaatatgaatatatcacgtttggaagactgtttaaattatctctagtaagaataggtaatgttgacactctgaaattctattcatttatgtggaaatagaagctcactctcaacttcaaaaattttgccactacatagcatctggcacagtgcctggcacatactacacactcaataaatatttcttcaatgtataagtagtataacttaattatgaacaagacatagttttgatatttctgattgggaatttttgtactaagattaaaatgtcaacttctattaaatctgctctctgagatagtctattagtttaatttgaattgttccaacccctggctgttacccagttccaaagtcacttccacgtgttcgggtatctttatagcagcaccccactctctgcggtaccaatgtactgtactagtctgttctcacgctgctaattaaagacataatagagactggataatttataaagaaaacaagtttaattgactcacagttcggcatggctggggaggcctcagaaaaaatcatgatggaaggggaagcaaacatgtccttcttcacatggcagcaggaagaagggccaagcaaaaggggaaaggccccttataaaaccatcagatcttgtgagaactcactcactatcatgagaacagcatgagggttacactcccatgattcaattaccttccaccaggtccctcccacaacacatggggattatgagaactacaattcaagatgagccaaaccatatcagcattatttatctttgtgagaaagcattgtttttgaagatacggctctctcatttctgtgaattccagaaatttagctttcctgtaatttaaactatgagtcacatgcattgtattattagtacaagagatgtccacatttagctgcattatcacatttttaattattgacagaaaaattattatgaccataatccatgtgcaacctaaccgaatgtcacgttatcatctataaataattcctacttcttattagtccaatagcttaattatcaatactcatcaacactcatatattgtctgttatatattattgcaccagaatcttgctactgcttaatcacccatggggtatgatatcaacatatgaggactgaatgaaatatcagcaccatttttagagctcctgagaaagtaattaaaatatttggcccacgtcacttgatagaaaaataggaacagaagatatctaagtagaggtttacaaagaagttgagatttctactctgtcttaatttcagttagatcagtgcttctcaaacttaaactgatcagggatcacctgggatattgctaaactgcacaattctgattctgtatatatcagaatgagagctgagagtctgcatttttaacaagttctcaggtgacgctgatgctactggtcctacaccaccttgatctgcaagttactattgcttaacattactggaagaagtaaaacagaaaaatcaatgaacttaccaaattgtgaaataaaatcacaattaggagtttgagattgtgcacctccaaagtatttactgcaacgaattcaattccaagattggaattacctgaataacttaatttagttgttcatctattcattcatatattcacatacgcaaacttcactgcacttgggagaaaataacccactcatttgttcagcacctccttttctctatccactctcacatatgccatcttatttccagagtcaaatagacacttgggggaaaaaaaaagagatgagccatatttgttagatgtatttttctgtccagtcaaagcattgatggtgattcacaattattttccatattatggcttgtgtatctacccagatactattcatatctctcctcctgctgatataaaccaaaaaacacaacttcacttggcctcctgacttgctttcatttttttcccttaccgtcacagaagttttagtttctgcctgcatgtcctaactacaattatcagaaaagttgatggaacttgctgtgcttaactttgagtccttataaaaatgtcagtaaatcttttttgctctctgcaggttgcatttttcaatcaaattaattagtttattcatagagaagaaaatcttctgttttccctgtgccagttgtcttcttgcacttccacagttggaagttgtgtgtttttcttccgaattccttacctcctaccatcccaagtgtattccacagcattaaaaaaaaaatcattggcttactcctcttaaggggttctaacaaaaccacatcaatattctcttgttttaaacactacattatgaaaggaatggcacttagttttctcatttaaatcatataaacattggtaaagttttgtaattgaccagtatcggcacgtgccaaactcatttgtgactggagatgtgttaataaacttctttattgtattagcttttacctcatcagaaatttatgtccataaaagcaacagaattggagggaaaatacaatagcaaggaaagaatcaaatgagagtgtggttatgaaggagaaagaaaggaggaagtatctgtatggttatctttcctgacattcctttgtaagcatatttttaaatgttgccattgtgaaaaaataactgcaaatgtatttctaatcatcctgctcatgctcccttatccccatacaaaataaccacagctatactctttgggaaaaaaaaatgactgaggcaattagaaaaggctggagaaaaaaagtaaaaaacatctatgagggtcaggtttggtagctcaggtctgtaatactagtactttgggaggccaaggtgggagaggatcacttgaggccaggagcttgagactagcctgggaaacataacaagacctcattccctgcaaaatttttttaaaagttaaaaaattatatataagttattatacaaaatatatgaaatataattatatataaaattatataatacttcatatagaaaatatcaaattacatataaaaagtgacatggtatggtaaaatagttaactgacagctcatcatcttatttatcacagttatctttcttcacattttataataattttgcattcacaaactaactttttataccctatctcatctagtatctttcagaggtatgtcagcctcatgacactattgctgttttacaaaactataaagtagagaacagaaaagaaaagtatattgccccagttcacataaataagtgtttgagaaagcaagcccttattccttaggcaaactggagaggattttatgtaaggcagaaatcagggcacgctattatctttgtatttttaatatttcttgttttgcataattgttgatggtttatgggataaatattatttcctagatgcaacttgaataatagtaactgtgggcacaaattgaagcagtctatttccaaaggaaaaagcacttttactgtcaaaaggaaaaaaaaataggaactaaaactaaacagagaagtggtttttaaaataactaaatggctaagatagtaaagtatacttttatcacaactaccagctggtctaagacactactgtgtcttaactggccaacttcactggcctaataactgtcctctcttcctccagtggccttcctgataggttttcttgacctatctctcacctacataaaatctgatggctttgtcttgcacttagtctagaattcaaagcccttattcaaagccctgactgacactacaatatgtaatcagtctcctacctatatttcaaccccatctcagacctcagccatctaacttaccaccctgcaactctacagtccccctggccttttggttcctccagcaagccaaactgtccctatttttgggcctttgcattagctgttcctaatccgtgaaccacacttccttgtgatctgcaaatagtggtaccttcttgtcattcaaatctcaaactaaatggtaccaaccttcaaagtcttacctggatcacaaagtctaaagtagcctcccctcaaccattctctatcacattacattttaatctcttcaaaaactatattcctatccggtatttttcttgtgttcttttttttcttggctgccagcctctacagaatatgtttcatgagatctggggccagaccttgtatgatcattattgagtctccagtgccattaattgtttttgataatgtattccattaatatttgttcatatagagagatatatgtgtattttatacgtatatatatatatatatatatatatatatctcacaatgactatatatcaaatataatttgatgttgctattaggttggtacaaaagtaattacagtttttcccattacttacaatggaaaaaaacatgattacttttgcagcaacctaatagtaagtatgttggtagataggattaataattgctaagtgtaaatgttcatagattttagtgataagcttatctgtatttacaagaagtttttaacttttgttatatcaacttagaaattatagcatagctttggatatacttaatatgactagacaaatgttaattatcatttctctaatcgctaaaccaaggcttaggcaggaaataatggcttccgactggatctatccaaaccctgtcttaggtagagagagaaaagaagtatcgatgaatccatttttgtttactagtaatcttctactctgaagtaatcatatatttagaaaaaaaataggtaatgctccaagttgaagctaatcattggagataatccattctcatgaccatgataatggaaactgaacaggttataatttatttgaagcattaagtaaaacctagattagttttttaaaaataatgacaataccctcttttcataatcacgttttttgtttcctctcacaaaatctttcaaaaatcaggttcagcaaagcttacataatggcttatcacattagaatttaataggttttatgcacgaacacatacatagtcaaagtggcaaggaagactgttatttataaactctcatattatttctgaatttgtgttgctcaaataatgctttgtatattcatttttaaggaattttccagaaaagtctatgtgatagaagtggttacatgtacgtgtctcattttaaaaactctgtgagatgttttagcaaaagctataccagctagaaggctctccttgccttcttaataattattctaaaagctgtaacacgtacaaaagctcttgaatcttccctaaggacaaactaattttttatgtcaatctcagctaggtggtaatactgccattttagcatttccattctctagtgggatggggatgaggaaattacacgcacagaagtctaggtgtctgtcatccttcacttaatggcagacatcccttgaaggggggaatttttgaatgaacatctttttaaatgttagaatcacagataaaagactttttttatgtttcagataagcaaagaaaaagttgcaattttaattccaggaggaattcatattttcttgcaactcaatttcacacagcaattaattaactgattagtatgaataattaatgccatattgttagttttattgaaaatggggagtgtaagaaaaatgagagcatttagcctccaggagaggatggaaacctagagtgcacaaaggagaagacactggtggctattatggcaaggacagtaaagaggtggttggattttcaaaactttctaattttgtttgaggttgctttaagttccacagatcactgcaaatagaagttctaacctgaagaatgttggcatatgaccacagaaggcagcttatatcttaatatcgataatagatggagtaaattagtggacctggtaaacactggggagtgggcagactcaacagttataatatgattattgtacctctcacatctaggggtagtgacaatcatcaccacgatcacagcaggcgaataatatcaatatgcatagattagtatctcctggcttggaatacatatatagttatgaaacctctatcttacatgtaccttatttattctttcaaaaggcctgagcttaaaaatgtgtttttcccctccataatttcacactataatttagtactggaataccaatccttctagcatatctaatgagtttccttggtccttttttttttttaacgcttttgaacttcataaataatagttaaataaacttaaggcatttggacaatttttttcacttaatgtattcaaatccacagttggcacttcatttcttttcatttaaaaataaatctatcttgtcttgataggctttacatgaatatacacacctaacaatataaatcaaaacacatatccagaatgatgagatctgcttgttacctttataagaaatatgtcatttttcagaaatgtctcaaatcctcttttttattaagtcaatatatattcttaagataattcatagccatactgtattttaataagaatttcccaaaacgtttgaataatgtttttcaagaggatttccatatatagatgagtaactctttaatattttcaagggctttttcttcagaagagaagtttcgtgtcaactatagctaataggtgattttatgtacacaatctcctgtgcatgcttctgtgccttttatagtgacattttaatgtttggaggaaaacctagaaaataataactatgacagaattttggcaaatcttaaaacatagttctgtagataacagtgcatctatctaacatctgctcttttagttacaaaagtgaaaaccaaaatgttatttctatgaaaatccaaccagtctcccttgaaagaaagctgtgtgccttgggaacaaactgagaatcgtaacttaaccatcaaaccacatcaaaataatcacaagcttccaaaacttgttagtcttcttaattaaaaacaaataaggacttacttgctttgtttttccatgctagctaccctgaggcattcccatcttgaatttaggagattcatctgctcttgtacttcagtttcttcatcttctgataattttcctgttccaatcagcttacttcccaattgtagaatattaccaacccggccctgatgggctgtcaaatccatcatgtacccctgacaaagaaggaagttaacaattgtaattagaactctaggtaaatcggtgtggttttgagttttatttgtttgcagttttaaacttgtggcccatttagatttatattcccagtaaaaggaatttaatttgtatttgcagaatcccaaaaccacttttaatatgaattaaggaaaattatcttaagtcaagttcttcagaagcaggccccgagataaggacttcagtgcaagtgatttattaaggaagagctcccaggaagttccgcaagggagttgaagatggaggaaaaaggacagggaagggaaagaagccaaacgagtgtatcatctcaggaaaagtctcccactgagagaagttaagcccaataccatacatcaactcaggaatgtaagtaatgcctcagcactgccttgacacaagagaaagaagttgggctttcgtattcctgttggccgatcaggtagaaatgccttcaatggttgctctccaaaagaaaacttcaaaatctgactgttggaatcccaagcacatcatagtaactaaatttccaaaatacaaggatgtaagagagtaattgaggaaaaaggatgacttgccattataacaagtcatatgttttgttttgtaaattaacgttttagtttacctcatgagtatgaaactggtctttcaccacttccacatcattagaaatctctccttgtgcttgcaatgtgtcctcagcagaaagaagccacgataatacttcttctaaagctgtttgataacggtccaggtttacttcactctccatcaatgaactgccaaatgacttgtcttcaggagcttccaaatgctgcacaataaaataaattgggtgttacacaattaatgtctttgcagattgttccagtacattaaatgatgaatcgaatgaaatatttaaaatgctaggactgtccactggcattatcaaacacaggaacagcagatacagacaatagggagttttcattttaacttcctcatgcatacatcaattttcaaatagcggtcaaaatccacaccaaattaatattgtattaaagctcttctagattactggaaggagtaaattagtatatcacctcatgttgctttttaaatgctataaatattgatctgtaggaactttcctcatttcttatttataataacttacatatacattatcagaattatatttacatacctctgcaatggcattaaaggaaatatctcttcctgagaggccctaggtaatgaaatatttccaaatatttacagaccagtaaaggcatcagtaagaaaacaaggaggtaggggaaaggaaggcaaaatttagaaagaaaaaaaatacctcacccacccatctaaaatttctaacagcataatgacttctgtgatttagcctttatttccagaaggccacgatttaaatagtaagacattatcttagaagaactaaaatatgaagtatgctttacccaatttaattagcaggatattaagtgagaatgcaaatggttgtcttggaatttccgtctggaccctaaagccaagagcaaagtgtacgaagcatccataattctaaagagaagatccagggtacctgttaaaaaattgctaagaagtgatcacaaaattggtctcacaacccttaatccaatatctagcttaaaggtgtgtaagagcaagcaaggaggtcgattagaaaaatctggtgagaaaggcttcctctggagaggctggagcgctctgcgtggctctaacttctccccatctgaagccaagtaatagagacggggtagtttacatgagctgtaaacctggccatatgtttgcagagatttgcatgctataggaaccatacactcaagtgacaggagaggcttcttgggataaactacatgtctgctgctttaacctaaaggcatttatcaagggcaaaaatttgagtaaactactaagtttgcaggaggttttgctttgggaggagtgtactccttgcaggtcgccgggcttcaaaaatcctgagaacatgctcaagagggactttgctgaggtcaaggacataggcatactatttacggaggtgagcagaacaaacaaatattggagaaatatttgtagaagaatcttctgcattccacaaatattgcaagcaagcacggggccccctaacaaacagggttttgtaaaggaatcaaaaagcagtgtagaacaacagaagctgtttgggggatttcataatctcacccagagaaaattcaacctttggtggctttcccctggtgtgtatgtgctacatttcctgtccttctcagttctgggaattaacccactaagctgccagcaccaacttacttgtgctcttctgataaatgctcaaattttgaaaattcaatattttaaatttccccaactgttaagtccttcgagatgacaaggcatagtggcagttattgcaatgacattttcatcaaatgatgcactctttttccagtttctataaaagtggcagagaaaggtcatcctggtaagtcaaaatcaccgaacttcatcatatcaaagagggtaagtgcactgaaagggctatttgcatggaacccttgtctaacagtaaggcaatttctgaaggtcttaggggttagaacaacttccatggtgtatctcttccgtctctaaatactattaataataactatcaaagtcagcattaagggggaaaatgatataaaggcagcctgagagatgtgcgcaggtggaaccagcttcacgtttgtgcaacctgagcagttgcacagggccctgagcgcagaagaaacacatgcctctattatctgctgatactatcctgaaattgtaaataattttatttttgaatttgtgttttagaagtgaagtcctatgtgcaatgaaggatgcacatgcgcagaggagacaggtggtataatatgtgtatctgtcctatttgcatatagcattttcaatgccctagaagcacagaagtctggtgagctcacagtaagtttagtaagattcaaagaatatggcgtaagtgtgttatgtctataactgagtaaacaaggttgctggcagccctgggagataatgcttcctatctgaaccagaccctgcttcaaatgcagcaagaaggcaattttttcaagaaaatacaaacgaccaagaaaccctatcatatcctttcctactcctgttatgttcctatatgaaccaaccacttatgctgaaattgatgatatagaaagaaagggaatcttgtgactttgggagttacctagccctgcataagccttagtttctgcttctgtaaaatgggaacaataatacttccataataagattgtggtaagaattaaagagtgcataatgcacttcacagagtgaccttgtataacaactaaataaagtatgttacggctgtaattattatcaaattcctctgcatatataagaagtgttttgaagcataaattgccccaagattaccttcttaagtcactgttcaggtttcaggagatggaaaattattgtcgaaaatacgcccccaaaaatgtgtaagagcaaacattatttaactctttttgaaatctgaaccttaacctagctcgtatttaagagttcttaaaaatcattaactatcttgagttcaaataatcttctccaaacgaagcattgtaaacagcactaatactcaagtaacacaatactttacactgtgcaatttgaatcaaaatattaaacactttatgatttattgatatttacacaggattgaattttggaagaaaatattaaaaggtgtatacttatactcaaggacatgacatctagtactcaaattctgaacctaaatattttgtctgaggatgtgcataaaacaaaaacatttcaaagacagccttcttaaagataaattcaaatctgaataagctatgcaaaattttatatttatatccatcaattcaactatatatatacagaattataatcaaaatttgaatttaagatctgagtaattatttgtctagatagactattgtttttcaaattgtaagtcagaatccattcatggttcataaaatcatgttagtaggttatgactaggaatattttaaaattaaacagaaaaatagtagtctgtgtcacttatataatactaacaattattgtctcaatttttgtttcagatgtgcatatgggtttattttgatatgtatatgtatatatgttctaaggtgagattaaacttttttctgcagtttgtaaaacaaaattggaaatggctctagaatttcagactaagcaaaccgacgaaaaaagaaatttgcctgaattctacatttgtatattttccatagagaccttggaataaaagacattttaaaataaaacgatgtttaatctgagaatttggaaataaagatataaaaagtggcttatgctttgtttcagcaccccaaaatatgtttttatcatcacagaattttacattgtacctaagattggagatcacttcatacatgtcatggcatcaaatgaagagattttctaggaaagttggtttttgttctttatagatctatttataagaaagatagaccccaatcgtttcatgaatgaagatgccagtatcatcaactggaactaattatttttcctatgcttcaatcctattttgtctttatcacagtagtttatgtttctcttcagtacattgggcaaataatgattacgatgagaggcatgacagtgaatggatgaaacgattctgtttttgttttttttttttcccccaaaattgagtacactcaaatttattcaacgttatccacagacttcagaggcttaattactgcctgttagatttaggaagtattagatattgtcacctatgttccttgaagacatcgctcattaaaaaaggtggaagaggccgggtgcggtggctcagacctgtaatcccagcactttgggaggctgaggcaggcggatcacgaggtcaggagatcgagaccatcttcgctaacatggttaaaccccgtctctactaaaaatacaaaaaattagccgggcgcggtggcggcgcctgtagtcccagttactcgggaggctgaggtaggaggagaaaggcgtgaacccgggaggcggagcttgcagtgagccgagaaagcgccactgcactccggcctgggcaaaacagcaagactccgtctcttttaaaaaaaaaaaaaaaaaaaaaaaaggtgaaagagcagaaaggagaaaggtaaaaaaatcagggatgataaatgactgttttagtccagcaatgtctagaaaaatctctagacactcatttctggagacaatttctagtcataatttctactcgtagaatttctctgactagaaatggttctaatgaagtatacagcaatagccttgatacttctgaatatataaatatattttaaaatccagtttactatctgtctgatcttgggtatttaacctctctgcatctcagttaccccatctataaaacaagaaaaataaaaatatacgtacgtaaggctgctggaaagattagatgagatagtgcatataaaatgctaagcacattctagatcccaagaaatgctctgcaatgcctgtgtttgggggccaaagttcattgaaatgataaatgatttttatggggaaacaggtgaatgagctctgtgtgtttctggaagcatgatttgggcaattcaaactgagataagtaatcaagtggctacatgtaggtagtgaaaccagcagcccagcaaaccacaaagctcttagaaaaaatagctgggacactatgagagggcacagtctatcactgagcagttttatatcactgataaaatggattttggcaatttatctaaattcagccttaaagtatgatacgactgttaacctggatcaaaaacagttttattggtcttgaatgcataaatgcttcaagaacatttgcaaattttatcattctcagttcatttaaatgtatcatacttctttttcatggagtctaagtcaatgcatggatggtgaattttttggtgtattctataatctttttacccctcagtaaaagattatttccaagataaaggattacagagggataaccaagcggttctttcactaaataacagaagagcatttctgaacaaccaggattagtacctggaaatattcttgacacatttccgctgtgttttctcacagatataacacgtaaaccaaggtactattcaaagcataaaaatgattactgaagtgatttatgagaaattaatccatcatgcaacactgtacatgacattcaacctaatgacactattaaataggtaatttttaatatagatagggcctgaaattgagttcaaagttaagccctaatgaggatttaggaaaaatcatggcctgctgttagggcaacaatcaacaacaaatacaactactaccgcatatacaacagcaataacaacagctgccattatttattgagtacttagtgtcagtcaatttgctaatcacttaacacgcattatatcatttttcactacaacagatcagggtgatagaaattagtaggatgaggaaatggaaatagaaaaattagatgacttgccaaaggtcacaaaggtaactggtggttctgggacttaaaaccaggttgtttggattccaaaacacgtctttatcccaatatgatcaatctctttaaatgaagaaaatgaattaagagtctaagcaacagcacttttaaaaaaatataatataactttttttttttctgtttttttgagattgagtattgctcttcctgcccaggctggagtgcaatggtgggatctcggctcactgcagcctctcccttctgggttcaagccattctcctgcctcagcctcccgagtagctgggattacaggcacaagccaccacaccgggctaatttttatatttttaatagagacagggtttcaacacgttggccaggctggtctcaaactcctgacctcaggtcatccgcccacctcagcctcccaaagtgctgggattacaggtgtgagccacggtgtccggccctcacgtaacttcttaaaaataagtcaaagtgtattttttcttaatttccacaaattcaatcaatggtttggaagctactaggaaaatacctcgtcttcattacgttgctgagtaggaaatcaaatgtcaagtctaaataatgcacgcaagtcacagacactgatatcacactgaggaagataccagaataccagaaagacagcaatgggacacagcccagatggtagtacagacccggtaaatcctccattatccatgatgtccttatttcacactgcatgtctgtatcaaaacatctcatgtaccccataaatacatacacctactacgtagccacaaaaatttaaaacataattttaacagttttttaaaaacataaacagaaaaagaagtcagaagaagctgagcaaaaaataaagctaacaaattctttctaaaagaaggcatgtgtcaagtccaccattcgaactctgcgccttctgttaatccctatgatttgcctttgatgttaaatgtcagcaaatttaacattcttcactattgcagaaccactcacagaaatgctacattgtgcctccgatgctccagttaagaagacaaaaatgggtatcatacgtacacatatggggtattttagtttttaaaaatctcattctatagcctattaaacaaaaggttctagagccaaaaacattaatctttttttttatactttaaatactagggtacatgtgcacaacgttcaggtttgttacatatgtatacatgtgccatgatggtgtgctacacccattaactcgtcatttaacatcaggtatatctcctaatactatccctcccccctccccccaccccactacgggacccagtgtgtgatgttccccttcctgtgtccaagggttctcattgttcaattcccacccatgagtgagaacatgtggtatttggttttttgtccttgcgttagcttgctgagaatgatggtctccagcttcatccatgtccctacaaaggacatgaactcatcctgttttatggctgcatagtatttcatggtgtatatgtgccacattttcttaatccagtctatcatcgatggacatttgggttggttccaagtctttgctattgtgaatagtgccgcaataaacatacgtgtgcatctgtctttatagcagcatgatttttaatcctttgggaatatacccagtaatgggtatattactgtaatgggataaaatgggatggctgggtcaaatggtatttctagttctagatccttgaggaattgcacactctcttccacaatggttgaactagtttacaatcccatcaacagtgtaaaagtgctcttatttctccacatcctctccagcacctgttgtttcctgactttttattgttcaccattctaactatgtgcaatggtatctcattgtggttttgatttgcatttctctgatggccagtgatgatgagcatttttttcatgtgtctgttggctgcatcaatgccttttttgagaagtgtctgttcatatcctttgcccactttttgatagggttgtttttttcttgtaaatttgtttgacttctttgtagattctggatattagccctttgccagatgattagattgtaaaaattttctcccattctgtaggttgcctgttcactatgatggtagtttcttttgctttgcagaagctccttggtttaattagatcccatttgtcaattttgactcttgttgccattgcttttggtgttttggacatgaagtccttacccatgcctatgtcctgaaaggtattgcctaggttttcttctaggtttttatggttttaggtctaacatttaagtctttgatccatcttgaattcatttttgtataatgtgtaaggaagggatccagtttcagctttctacatatggctagccagttttcccagcaccatttattaaatagggaatcctttccccattgcttgtttttctcaggtttgtcaaagatcagatagtagtagatatgtggcattatttctgagggctttgttctgttccattggtctatatctctattctgataccagtaccatgctgttttggttactgtagccttgtagtatagtttaaaatcaggtagtgtgatacctccagctttgttcttttggcttaggattgacctggcaatgtgggctcttttttggttccatatgaactttaaagtagttttttccaattccgtgtagaaagtcattggtagcttgatggggatggcattgaatctataaattaccttgggcagtatggccattttcacaatattgattcttcctatccatgagcatagaatgttcttccatttgtttgtgtcctcttgtattttggtgagcagtggtttgtagttctccttgaagaggtccttcacatcccttgcaagttggattcctaggtattttattctctttgaagcaattgtgaatggagttcactcatgatttgcctctgtctgttattggtgtataagaatgcttgtgatttttgcacattgatttgtatcctgagactttgctgaagttgcttatcagcttaagtagattttgggctgagacaatggggttttctagatatacaatcatgtcatctgcaaacagggacaatttgacttcctcttttcctaattgaataccctttatttccttcttctgcctgattgccctggccggaacttccaacactatgttgaataggagtggtgagagagggcatccctgtcttgtgccagttttcaaagggaatgcttccagtttttgcccattcaatatgatagtggctgtgggtttgtcatacatagctcttattattttaagatacgtcccatcaatacctaatttattgagagtttttagcatgaaggttgttgaattttgtcaaaggccttttctgcatctatggagataatcatgtggtttctatctttggttctgtttatatgctgcattatatttattgatttgtgtgtgttgaaccagccctgcatcccagggatgaagcccacttgataatggtggataagctttttgatgtgctgctggattcggattgccagtattttattgaggatttttgcatcaatgttcatcaaggatattggtctaaaattctcttttttttgttttgtctctgccaggctttggtatcaggatgatgcttgcctcataaaatgagttagggaggattccctctttttctattcattggaatagtttcagaaggaatggtaccagctcttccttgtacctctggtagaattcggctgtgaatccatctggtcctggactttttttggttggtaggctattaattattgcctcaatttcagagcctgttattggtctattcagggattcaacttcctggtttagtcttgggagggtgtatgtgtccacgaatttatccattccttctagattttctagtttatttgcgtagaggtgtttacagttttctctgatggtagtttgaatttctgtgggatcggtggtgatatcccctttattattttttattgcatctatttgattcttctctcttttcttattagtcttgctagcgatctatcaattttgttgatcataaccagctcctagattcattgattttttaaagggctttttgtgtctctatttccttcagttgggctctgatcttagttatttcttgccttctgctagcttttgaatgtgtttgctcttgcttctctagttcttttaattgttatgttagggtgtcaattttagatctttcctgctttctcttgtgggcattcagtgctataaatttccctctacacactgctttaaatgtgtcccacagattctggtatgttgtgtctttgttctcattggtttcaaagaacatctttatttctgccttcatttcgttatgtacccagtagtcattcagcagcaggttgttcagtttccatgtagttgagtggttttgagtgagtttcttaatccagagttctagtttgattgaactgtggtctgagagacactttgttataatttctgttcttttacatttgctgaggggtgctttaacttccaactatgtggtcaattttggaataagtgtgatgtggtgctgagaagaatgtataatctgttgattaggggtggagagttctgtagatgtctatgaggtccgcttgttgcagagctgagttcaattcttggatatccttgttgacattctgtctcactgatctgtctaatgttgtcagtggggtgttaaagtctcccattattaacgtgtgggagtctaagtctctttgtaggtctataaggacttgctttatgaatctgggtgctcctgaattgggtgcatatatatttaggatagttagctcttcttgttgaattgatccctttaccattatgtaatggccttctttgtctcttttgatctttgttggtctaaagtctgttttatcagacactaggattgcaacccctgcctttttttgaaaaacattaatcttaattcctacattaaaaaaatggctctggcaaagattgctcatcctccaatatgtatctttcttcaccctttatgtagtattagaaagtttaggggacaatttggctatctagaaatgtcactacagttcccactttcccttgcagttagatgtggcatgtaaccaagtattggccagttggatataacgcatccaacttcgtcattaagacgtaaatgggcatagatatgctctcttcttcgtcctccctcctgaaggtcgtgatacacacatgaagctggtgagctatcctcaaccgtgactacgaagacagcgtcccaggggatgatcgaaaaactgggcaacaggactatggatccctgaatgagcagagacttcctacaaggcctccatcactcccatctacacaacatttaagagaagtaagtctgaaagagaaacaaactcattttttagttcatccatccttgtgtttttgttagtgccacgaaacctacagcaatctcatatactgatatactctaattttctagcagctgagattttactataaaaatgtatctgtaaaagcttatatgtgagtttaaaataaactttctactataaaatcagatgtctctctaaaactctactctgtctctctaaaacatactctcaatgaaggttccagtcattttgcttcatcgtttttcaagtcacatacctttagatattacactaacccttgcattgtaggaaggcggggacactgaccccgtgcctaacagcacagtacacagataataaatatttactaaattgtttggggtaattttaatttcttatttaaggtcatttgtgcttccaatttcaggttttatataaaatatgttttaaccaatcaataccttgaaaatggagtaatatggcataaaatattcatagtttcaaatatatgtcttcccaatattcctattcatatttcatatgtgtttatacatatatacatattcacatacatatatagtataccaacttatatgtgtgtgtgtgtgtgtgtgtgtgtgtgttttcttcctctaatttctctaattctaccatttatatctttgggtatacatttactttctaacttattttatattttattcctttattttttcctgtacttcacctgagactttctgtcttggctattataatccacacaatagaacctttctcataaaatcaagaaggaagaaaaagaaataagcactgttatggcaaattctcctaaatcaatggaaggtcagagagaaaataatagaagatttagagaaatgtacctagaacaatttaataacccaatataaaagatttctttttaaaagcaagtttataataaaattttcataagcatcaataaaaaaactttctcagaaatttattagatggcacatgaaagacgtctagcctagtgatttctttgttcttactgtttcatataattcttacaaacaccctaaaaggggggacctatttccaagatgaggatgaggaaatccaagtcacacctatgaggtgtgggaggaaaaatgggatacccagtaaacaaaccgacattccttggctgacagagattcatgaagtccagagaagaaggatgaacataataactctgtactgtttggtggatgtttcaataattttaaaagtcagtatttggttggaattcatatgagttggtaattgaaacgagattttgtaaaagtactaaatttaatttaaaataggatagttacaaaatgtctcagaagaccaaataaattcttaatgttattttccttaatcctaagtttaacaattttattaattttcaaatacgtctcatggaaaaacaccaagtcttatttattttaatcagtcatttataaataggaaaaaaatgattcactggatacttttaaaatgcaaaataattcagaagtaaactgctttagacaagtggtttttacataccaaaaaaatcaaaacaaaatacacatatctcgtgaaaacttattatttcaaattgacatatactgcacttaaataatattcctctagaatgaccgtagtccatagagtttgtaattgcatatacaaattaattgtgagctatgaggagaacctaaacataaatattcccatgtagcccgttttggaattttgctttttttctcatcatttataatattcttagctatgtactcatttattccacaagtctatatgtaaagaaattagaagttagcacaagagatgtccccaaaatatagaaacttatctacacttacactaatttcagtgaaaatcttattcttcctgttatttgatccaagactccttaaccttaagcttttttctgtaaagggctagataataggtatcttcaattttgcagaccactaaagaccagatgcccccaactcagctctgtcactgcaaattgtagccccaaagcatctggagacaatacattaagtgaataaacatggatgtgttccaataaaactttatttacaaaaatcaggtagcaagtctattttcaccctcaggccatagattgctatctcctgatgatgaaattgcttcccacatttaaactaatttctctgaacttctcactgttgattatctttcctctctccaatctctccccctccaattgattctcattgggtcactttcccactctattgcatgtccaagctagccatctctgaaatctcactgccctccccctgccctacctccattgctgtatataacaatgtctcaaagaaatcatgctgcataaaaccagtggccgcattcgggaaactttaagtcggcctcactttggagtaaaataaacatgaggtcaaattcaggttctggaatttataggtagtgtgtacttgaacttggcaaagttttttaatttcacactcttggtacacacctgaaaatagatatgatactaatttagagggtaattgtaaggctcacagacaacatacagcgattgtattgacattcagcatcaccctttgccattcaacttttataaaatcactttcactgcctcattgtttttatttagtgcaacccagaatagagaactaacaacaataaagaggagtttggttcaattagattttaggttgtaaaaatattctactaaattgacacatcttttctaactaggtaaattttctccaaggacattagctatattcacctccttaacatacaccagttgcttggtttatcccgttacctttcacatatatcactaaattctgtgtgctttctctttatttatgttacatacctttgtctcttttccttattccttaaacaaagatgtggtatatccttcataagggagagaaatccctatgggggaactaatgggtagcttcctgtctctacttcttgggcatctatagtgcttctgtgggatagtttcattattaaaattagggaaataatataaataactagtgagctaattaggaagacaattataagggtgtgattgtggaaatggggaagttcttttatgagaggtgatgtagcatctcggaagcctcacgacagtagacagtttattttgttcagcacctgacatacagtataacatactatatgtttgttgaatacaataatgtgtctcttagcatatgacatgtaacaatattccattttaccttatactgatatgaggacattttttttcctaagagaattagaccaaggcatctttccatgacagagcagggacaagaaatgacacaaactccacttgtttatttcacttactgccttcttcaatgcagtgttggcttccctattcaaggaaagagattcttggaatctcttcctattcctttcctattcaaggaaaggtcttcagagcctgccatttcaaagaatggtattaattcttgggaagactctggtagatttcattaacacctgcaaattccaccctctgcctcaaggaaagtaataaaagtcctctatcctgttggctgaaagcagtggaaagttcttcaattttatcattggctcctaataggagtaatcatgcttcagggtctgtatctctgtgtcccatagacaactaaagcttttgatcttagggttcatagaactgagaagaacgcagtaagtcttttgcatttcagaaaaataaaagtatgaaaccttttgataagtttccatctcttgttatactaacattacttctcatattttcaagtaaaaaaaaaactcaaaatcagggtgggctaagtgataagagcaatcacttctgatttggtgaagatactagaagaggattaaaggatatgtacagatatgtgtatattaccaactgaggaaatggaagcatgagcagaaaagcgaaacagaaccctaagtgaggtgaacatagaaagtaaacgtcctaaagtcataaacagagacaaaacctcactgaaagttttcacttataatatttttaaacagatttgacatttctttccatttattttctgtaggtatagaatattttataactgacctatttataatgggactaccaccaaatatccatttttaaaatgctctctccatagcatgaatgtcttataaaatctagtctctttcttaatattgttaatacagaagcttctccttcaaagattgaaggtttttttctgcttttggaaataatttgagaaataacatagtactcacagccacttgccaacctgaaaatgttcagcatttatgtaacacttgaccttttcaaaaataaagtacataactcaatcttttcaactactttgccatgagatgtccagaacatttctgtgtagtaaaatagatttcctaggttactctgattttgctgacaaagattttaagtattctactacttaagataacataatctataaacacactttagtgttcatagacatagcagcacatcaagagcaccaaaaacgctaataaataagagagaggcctgacattatgcatcctattaaggatctctgattttccacagaagatatcaagtaccatatattacatcaaattatctgaaaacctgtatattaaaaattggtaaagtttatttctttcttaattcttaaataagcctgtgaagagacattataatatgtccttctagaaccccagttcatcgtgtgtatctcctaagtgggtgctatccactgtgtagactgtgctttaaattataatgctgtcttcatcatctaaattcttttagaatttaccaccagaactgaagtatagtgaattaagtgtttaccatttgtgagggatggtgtaagcactccactaaatcatctaatttaacctcacaacataagggatgattattgtctacattttactatgaggagacctgattcataaaggttagaaacttgcccaaggtcgaagagctaataaaaagcagagatgggaactgaattcagtatctgtctcacgaaatcctgaatattaacttgttgccagacttttttgtaataactcaaggggaagaaacatttcccagagatagctagatttataaaatttaatttaaaaatcaaaatataataatgtgttatattttatgtgaatgtgatcattctaagtctctcatacactcacagaattgtggatagatttctttgattcatccagtctttttcacccttagaaatttctgtgaccaattttatatgtttataatatgattgtatatggcatataatttttgcattctaaacagatagcttgtctatataaaaataaaaaatgaactaccataagtttcattagcacaatgccttaaaatttactcacattttaaattttaaatcagtacataaaatatagatacaatgaaatatgcagcaaatattactgggattttgttggtatataatcatacccgaaacctgtcaaaacttaaaacacacccattggtacatttcaacttatttgttctactttggaaagcagaaatggaaagaaacagaataaacagaaatacctttttgtcacatagtgagataatcaatactatgtttaaaaacaaagtttctttatattttcaaaatagcctctagtggaatcagctaccatattcttgatttgcataatacttataaatttcctacaaactcagtacatattctatttggaagtttttatatataggctttatattacactaaaaaggtcatcaaattattgccacgtccataaattaaaatatgttaaactccaaatatgaaagtacggcagctcttcaaaaaccttaacataaaggtaaattaaaattatgcaaattgagtagaaaactcatgcagaaactgtaaatctggaatagggaagccatttaaggtaaaagagaaatcgtcacaagtatgcttagaatttcctgatttagaaatagtgggacaaaatacaatcctacctatcaagcttttcagataataacattgtgcctaggcctgaaagtacatgcatgacatttgtttgaaaggattgtgattgccttgtaaacttcttttacaaatttattaacacgggttgttccgtatagttggccaacattgcttatttcttccactgccctacaacaaccataaactcccaattattctgggagtagtttatcagagtacagattatctggaggtgttatttctctttcatttggcctttcacagctcattagtacctcaacaagaaagttaaggcaaaggatggaaaggctgcagaatttctaaacaaataaatttgctccttgtcagcagcatatacagaacagcatttagagatatcacacaaaataactaaaatgggataaacaaagatatttaatgtatactgtggcaattttccttgagtgatttttccctctgtactgtcaaaaatattgactgaattgactgtaggttttggcatccaacagacctcaaagtcctttgtttttagcatgtaattgaccatctttagcgatatcacctgccattgagtaatgcattacatttgttgccaatatattgactatttttcaatgtgaagacaaaaactgaaaaccaaatttgcaaaggaagattgatgataatcttgagtggagtctactagaaagcttgtttgattttaggcttgccaatgcattcgatgccatcagcacagggatatctatccttgccttgaggagaaataagggaatcagaaaattaaggctcttttagtatctactcattagaggtgatatatccttaatcatgaaaataataatgtgttatatccattattattttgctttttaataagaatgtaagatatccataatcaattggtaaacttatctttgtctagcctatctactggcaattgaacaaataataaaaaaacttcaaatagataattttttacaaaattattttaattacagacttgccaggtagaagagcaactaacaaaagagcctttatacattcaatacatcataacttcatttattttatagagaagagcttgaaaatcatatggaattctggctctgtcacttagtacaaatagtgttgctttaacaaatatttattaagcaactacaaaggaccaggcactattttaggcaatgatgatatagccatatacaaaacagacagaaatctaagttctcattcagtgaatcatgtcactgaaggcatgctaatcaagagaaataagtaaaatagaaggatgtaagtgttatggagaaaaggaagcaaggaaggggaattgaaagtactagggaaaatatcattgagaaaaagatttaaagatatgagagagtaagtcatgtgagtatgtggaggaaatgtgttccaggtagaggcatctatgactgcggtggaatgagagacggtaacaacggtggaaaaggaagccagagaagaaacatagagaaaggaggaggtgattgtgcatgggcttataaaacagcaggactgcattttactgaatgtctggcaaggcatgggaaggttttcagcagaagagtgatgtgatttgccttacgttttaacaagaccatctggcagacaaaatggattacaggtaaggcaaggccaaagcaggcaggcttgtttaaaaggctatttcactaatttagaccagaggtgatggtggtggccatgtaagtagtcagaagtgatcagattctggatatatacctggttaaggtggacctggcataggtttttttttttttttttttttgagatggagtctcgctctgtcacccaggctggagtgcagtagcgcgatatccgctcactacaagctccgcctcccgggttcacgccattctcctgcctcagcctcccgagtagctgggactacaggcacctgccaccacggccggcaaattttttgtatttttagtagagacggggtttcaccgtgttagccaggatggtctcgatctcctgacctcgtgatccgcccgcctcggcctctcaaagtgctgggattacaggcgtgagccaccgcatccggccaaacctggcatagttttctaatcaacaacatcaggtgtgagaaagaacaagactaagtttgactcaaagatgttcatttggggcaactggaaggctatagtgaaaccttactgacacaggaaaaactattgacgaagcagatgtgggtgttagtaaatttagttttacatagggtaaatttgaattgactaggaatgtataaaaagttgtgtatctaagtttggagtttggcagaaagctctgagctgggggtaaacattgggaggcatcaacttacagacagtatttgatgccaggaggctagataagatcatcgagaaaatgaatgtggtctaagaaccaacccctggttactgtcatatcaggaatttgtgttgatggggaagaaccagcaaattaaaatcaaagcagatgctagaaaaacaggaagaaaacctggaatgtgtggtgccttagaaatcaaagaggggaaagtaaatgcatgtctcaaatcctcctacatttacttaagttacttaatttaggtagtacatataaggaatctcacattgtggctagcatactgtaaaaacttaataaatgtttgttgaacaaattatgtgtcatttcataacccaaccaacatatatcaggatactggttgtgatatatgcagaatacatttggcaattgagtgttaccaatatattatcaaacatgctagagaagtgtagtgtaccgagaattaagaatatgggctgtggaatcaaaatatctagactcaaattcttttctgtaccactgaaccttagtgttctcgtctgaaaatgggaataacaagaatataaactcctaatgttggtaagctaagttaaacatgttaataatatacatacagcatggaagaacctggtcttcagtaaatcctcaacaaattttgttattgtgccaattaaggcacacttaagaagcaatgtcttatgtattcaattaatactaaaatgagcacatattgtggattcatgtatcaactatgtattaatcactcacttagatcacaatggatataaagaataaaagagctgccctcaaggaaatcatagtccagtggaggaaacctacaagtaagcaaaaaatatatgtgctctcataagaacacgtccaagaagaaatggaagcattgaaaagggaagcgaaatatgaactgagaagtaggaatttttacacactactaagaccttgtcaagttagtgtcttcccttatggcgccatgtctaatacactcagcgttgtttcatcaacgtgttttcccggtaatcttttgggggaattgacagtcaaaccatgaacattggtactacatttatatttatgaaagatcattctggatgcagtgtggagaatgatctatggaagatgagggcagcaagaccagttagatatccagtgaatgacagtatgtaatagtcagaacctgactgctgccataagaactcaagaactgttgaaaaaatgaattgatgagatatatactgaggacttcaacaaaacagaagtagggaaagagggggagatgacagacttctgacatatatgatcttagagtgtattggacgtgggcactataaatatgacaaggacagtacagttgttgagaatgattcctaggtgtctttttttattattatacttcaagttctgggatacatgtgcagaacgtgcaggtttgttacataaatatacatgtgctatagtggtttgctgcacccatcaacccgtcatccaggttttaagccctgcatgcattaggtatttatcctaatgctctccctacccttgccctccactcccagacaggcgatggtgtgtgatgttcccctccctgtgtccatgtgttctcattgttcaactcccacttatgagtgagaacatgcggtatttggttttctgttcctgggttagtttgcttagaatgatggtttccagctccatccatgtccctgcaaaggacaagaactcattctattttatggtcgcatagtattccatgtatatgtgccacattttctttatccagtctatcattgatgggaatggtcaggagttcgagaccagcatggccaacatggtgaaaccctgtctctactaaaataacaaaaattagccaggcgtggtggtgggtgcctgtagtcccatctacttgggaggctgaggaagtagaatcgttgaacctgggaggcaggggtgcagtgagctgaaattgggtcaatgaactctaacctgggcaacagagcaataatctgtctccaaaaaaaaaaaaacagcaagcaaagacaaagcaaggttttgtgaggcaaggaattcaaaaccaccatatgacccaagaatccctccttctgggcatatacacaaaggaaaaaataacacaaccttgtaaagatatccgggcttctatgctcattgaagcattgttcacagtagccaagatatggaaacaacgtttaagtatccatggataaatgattaaagacattatggcatatatgcaattgaatattattcagtccttaaaaaaagaatgaaatcttgccatttgctacaacatggatgagcctagaatacattacactaagaatttaaaccttggatgacatcaatgagctctagaactcctcatgcgtagaaatcaccctacatttgactttcagtttatttaacaggtaacaacttctggttattactggcccggaagacgtttgtagtaaacagaagagacaactgtctctgtcctcatggaactcacacttttgtgtgattatacaagcaataaataaataaattatattgaacaaaaaaaagtttgttccaaattatatttgcagccactttatgaataaattgttgagcttagtgctgtgtgacacgataaattggaggattaagaaatgcattaagcaacaccaacaagggagtacaaatattatatttaaccatcatatttcattggaccttaagtgccattcttctagttttatggaggaaatgtattaggacatgataatcatctaatactgcactaaatattgtagtttactgttactgaaagcataagatggaaatcctaggggtcaacattatgtgacagaaaagatcacatgtataatatttgtcttttctacattttgtctatttgacactgggtcggctacaccttcgcttaaaagttctcaccattctctgcttttgtgttttttttttttttttttccagttttctactcaagtcagataatggtaaatctaattgcatcttgatgagctacttaaaaatacccttaaggctgggcactgtggctcatgcctgtaatcccagcactttgggaggccgaggcgggcggatcacctaaggtcaggagttcaagaccagcctggccaacatagcaaaaccttgtcactatttaaaaaaaaaaaaatacaaaaattagtcgggcatggtggcaggtgcctgtaatcccagctactagtgaggctaaggcagaagaatcgcttgagcccaggaggcggaggttgcagtgagccgagattgtgccactgcatgccagcctggcgacagagggagactccatctcgggaaaaaaaaaaaagtacacttaaatgacatacatttcatctcagagcctaagtataatttgaagcatttcaaattgctggcccatttgcttatcaaatcttgttatatttttgaatcacatttcattgttaaacaccctcagtgtatacactcatatgtccctatgcctatcaactttgtggactgagacaagaatattttttttacctcaagtgtaagaatgtaatcactatcaaaactcagactatttactgatgtttttctaaatggaatagtctgttgcattattcagtcatgagaaatcatgtttttgacagggcttgtttctcaagttggcttaaaaggttccttcgcatctctgcattattcacacattgctgtagaaggtgctaaaaacttggcatcaggagacagagtcctactgatcagcaggttatcatatgaatagtggaattccagcagcaagtgttttaaaacaaaatgccgcctgatacttattttatcatgttttataaaatcaaatcatgttaaactgttccagtgatgtcatggtctctgctctcttccctatgccatcttgctctctgataaaacttgaacttgaaagattttttttttttaatgaagggaggaaaatacagagactacggcattgaagagaattaagtaggaatcaatactaataataatcacttactaaaaatgggagtatgttagttaaatactaatgggattaaaacttcttatcgaagctgtatgctgaatgttcattacatttttctggacatttttgtcctgaaaaatcaacatttataggttgataccacatattttatatagcacattgtatgttatacacaggaatttacggtgtactgtagattcctaccacagagtgtatcatcaaaattaggagtttatcagaactcttaattctctcccaatctgaaatattaacatcattcttctatgaactatcccatctcctccttactttcatcactgaacctcagaattgattaaactttcctccttccagtttcccataatcagccgtaattctatgtattatttcttgttttccacacttatacttaaaaatccctctcacagcacacaagtatacttctaaaacagtagatccagttgcccttcccctacctgcatcctcctcaattcatttgcagcactgtttaacataactaccttctttaaagtctttttaaatatctgttatgtgatggtactttcctaaggaaactcttaaatcgtacctaactatgtctcccacctctagttccctacagatagatagatcgatcaacaaaacaatcaatcaaatattctgtccttgaacctcttcaaatttgattgtactttttttctctgtgaaatttcatgtactttttgggattactctgttatctctctccaccctagcccctgcaatgcgattctatcactggtcttaactgatctgttgataataaaccctgatttccaaatacagttagcttattctggaggcaaccttgacactttcaactcagcatggccctttttggttttttttggcaatccttcctaaaggcaaagtgcctctccattcagcttcataagtcccagggttgaaacacatgacttgttattcaaaacctgccaatgcccttctcttgcctactgaataaaatgtatctccttgagcatgatatgcaaaatcctccacaatgtgtccttcaacctcattttccagccgcctctcctactcctcctcccctaaccatatgccctacacacgaaacgaacagtcacaaaatgaactgacgattcgtgcttctttctcatttagctccacaaagtgaagtaatatttctatgggatgatctccttataaaaatcatacttgactatcaaggctcatcattcagttataccttctgctacctgctaagccaagatttatgaagctataatttatggtcccagaggatttatatgaaaagttattatacttcctatctctactgtgtcttaaagcagctgtaagagtgtctgtctcctctctagtgcataaagaacctgaggacaagtcaagtaacacccagtaattaacacaaattagatgatcagtaagtacttgacagattaaattactagtgtttgaccttcacatatgacactattatgtatattttaaaagtatcactgttgattagaaataaattttaacacaaaggccagaagacataacttagaaatcataggtttaggaattcaagatgcctaggtctattttactctgcctcttactagcacaaggacccttcagtaagtcttaatcttaatctgtatagtgggaagcttgattggtggtaaacctcataaatattgccattcaagtaactgccacatgctcctgccatattgtaagtgtacaatgaatgctacctaaattatcataaaacagtcaacagtgataacatgtatatgtgacgatttttgcaaaccttgttctatttggaattttaagaaagtaagcaacatgaaaccactggttgagaagatgtaattatttgtaaacaaagacctttatttttagtaaagattcatcagtgcaacctgtcagaattttctacttcaaatgatttaaaaataaatgattcaaaagtacagtttttttcctgctatggcagtagtgaacactgtactaatttgaacagattctgtgaatgccaaaagcattgtaatgttgacaaatgtgtacttctaaacagtgaggatgtgtgtgtgtgtgtgagtgggagaataatatacatataaagtacattccccagggtttgcttaggttttgatgacctaacccaaagcatcgcaaagatccaccaatatagatgacagtttatgttggaacacaatttaagaatatatactcagctacaagtgggtcggtacaaattgttaatatctcaatgtcaatactactcatgagtaaattaccaccaagataattatacatatatctctcaccttggatctttcagaaatttggcctaggtacttatataatgttctgaataatgtatctctctccattatttagtaaattatgtcagattcataaacatttctcaattaccagacatcaaactgttttcaacaaacttcttattccaattaactataacttcgatttttaaatttatgtacatacacacacacactctgagaaaaagagacagagttcaccaggttcccatttatcttcaaaattgaccctatataaatgttattttaaaacaaaagataaaaccataatcaggatactattattattaacaaatcagattacttggctatttctgcatatattttactctctgataaaaatattataatcattttctgccaaatataatctgcacctctgctaattactcattttccattaaaatgtaaaagtcaataaaacttatttagaaaaatggaaaatcatacatcaggttgacctgggaggctcccctattcttgtcctttacaaagtaatctaaccagataaagagcttcattttattcagcttattaaaccctatggtttgtttctgtaaattctatagtacacatttaagaccagtcatctgtgagaagaaaatgtaataccaccaaatttaaataacaatccaaactatgaaagtagatgcatatactttttatatgcttatgctttatataagctgtatagtatgtaactaactcaagtgggctcatccatcattggtttattgtttctctgaaaaaacacccctcaaggtctttatatgataaaatgaaaaatgacagaaaagaaaaatatgatgatattggaaataagcacattctgaaagccaatttgtcattgttttatgacatatatttatcttcatgtatatgagaacacctagcatagtcctttgcttctaacaggtactcaataaacttttgctaaattttgaatatattagttgtgggacaggtcctaaagtattgctctagaaatatttgattcatcagtaatagcctaacctatgctaaagatgactttgattgatagagggcagtccctttgaaagaaatccaactgaaatgtacagaacataaaaaaaatgcagtggatataaaacacagcattttccaagaaaaaatagagcatattttctggatccaataaaattagacacacacacactttcaaatacacttgcaattcatgatatattttattctattaaggatttatattattaaatcatgggaaaacactgaactctttcaaatactaccataaaataatttccaaactatattccatccttatgaaggaatcttgtggcttgggagcaattaatcacctccccaatcccatgcataagtcctgattgctttaaataaatcctttttgccagggacatagaacaaaaatccaactacaacattttatgctttaacacagtatattaactgtggaaacatgacttaacatgttccaaccagaaggtgtccagagttctgcttgactgagaaaaaaagtacttatttttcctttgacataagcaaagaaaaaaatgttacagttctggcagccatctatcataacaaaactgtatagggaaagaaataactacctggcatagataacggaagagtgaagagccaaaagagccactgagatacggagctgcagtgtgatgacaatgtgaatatttggattaaaggcttaccagaatcctgccattcctttggaattttctgttacataagccaataattcccaaggtttaattacaagaaatctttaatggaagaaaagatgtcacatgttactgctccaatgtggatgttttctgtatgtgtgtgtatgtgtatgtgtgtgcatgtgcgtgtgtgtgtctgcatatttcaagttttcttgagaagagttttccattattgtaccaaacatcattctagtttatatggactttggtatcaggaagtgggttgttgaaagttaatagatcctataatgtggaacaggctgaattatgagaagacaaggatgataaacctcccccaccccaactcaaaatgatacttggtacatgattaaaaaacagttgattaaacaatggtctattttatcctaagtcatgtgccttacgagtaccaacactattaggagatttgatagaaacaaaaatgttgccacctactggcctctttaaaccaagaaagaaaaaacctcatgctaatggttacttgtttttgaagtacagaaaaaaaagaaaatatagctttgtctgaagaagccctctctgcctgtggcttataacgtgaacgccttgagaggctgataatttggagcctgatatgagtggaaaagccaatttgtatttttactccaaatcgaatgtttgtatgaacagagacaggagaggcagaatgtaagacttaagtactaaaaaaaatcaactatagtgcttccctaaagcacttttgtgacaaagtagacgatccctcctatcatgaagaagcagcttctatgtaatctatacttcaaagatatactcaaagattggctatgccctctaccccaaccctgtgctgcaaattttctcagtcaggggattgtgcaaagcacagaggcctcttaaagatgtcaaaagaggttaacatttgaagcctaaaaccaaatcatagaatttgggttactgggtcatggaattgataagaacaaatactgaaagcctataaatagtaaacaaatctgattgccaaagaaaccccaggtctaactaaaaacaccttgttatcactcaaacctagggcaagcaccaggacttttaaacaacacaataagtagaataataaagtaacacaaaaccccaaaatatgtcaacttcagatatcatgatgaagacaagtatttagcaaaatttataatgaacagaaggaaaaatcaccaggaaggctctgaaagtgcaggatataatatctgtttcaatttggtttcttttataaatttagtttagttttaatcaggatgtgcccttctaactttttacttagcagtactggacatcaaattttttcacttagtcatagtccactggatggatcataaagactaattgaaagggactgctaatcacccagatatcccaaccttggagctgaatgcaatcactggataatgttttatacttgctctttttgaggagtctgagcatctttgaaagtgaatatatgctatgaagggtgtatagcaatgttggatattcaaagaggaggactgtagtaagcactgcaattatacagtcaatatcctttcttctactctctgatggcacagtagcctggtgatttggaaagcattgttattactctcagttctagatatgcgctcggtttttgtgcaagccaagtgggatactgctatgtactttgcttcagggaggtgttcaggccaggcatatgatctaagagtttccaagcagagagaaactcagaccttttgtttcctatttgggtaaagatatattctttacatttagctgtaaacaagggaaaagagtttccaagatctgctgagggaagccggtctgtatgagttcgaaaagttatggagggtaggcttagattaacagagaagcaaagacttctccttaaatccataataaaactctgtattaaacccttgagcaaaccttgaactctttacttagccaacaaattctctttgtatcttgagtacatttgaaaccaagcatcctaaataatacaggatataatagactttaatgttcttcatcaacttaataaatccttaaataatcaacaatcattctaatatgtacttatatcatcttcagtgccgaatgttctgatttcaaattcaatgttcaattgctcagttcaccaaatctagttaattgctgttagtcaaaaagcattctcattaatgacactgatgctattatcaataaaatggagtcattttgaattggtttgcttattcatcaaatggaatttttagaaaggatgtattatcttactacaactaggatgccaaatgggaatttaatgcaccattttttcacaggcttgctataaatcagaatctttaaaacatttctctccaattctctctcttccactcctgaaagagatggtaatatcatctgaatctctttcaaggaaaaaagattaatgaagtcatctgttgatagatttcacagcaattattcttcctcattaccagttcccaaacttcacctttcattttataaagtaacctttattttaaacctgcctgtattttaccttcttattttctggttgcctgatttataatttgtcattatattgcttatatattcatccacttttagtaaatcatgaagtgtgtgcataagtgtgtttatgaaaacccaacctttcctctaatgatagcttcataaagctctatgttgtgtcattttagcatacaggttaatagaatcaattctggaatgagattgtgtgtgtgttcaaatcctggcacagctgcttttcatgtgcataactgtgcacagatttcttaaccagcttatcaattttctcaagtgtaaaatggatatattaacagaatcttctcaatagggttgttataaacattgaattaatgtatgaaaagtgtttacagcaatgtttgttatataatgattgtccaatatcagttagtaatttttgtgacattattcatcatcacagacattatctaagagtaactggttcattatctaagatcaacactcaggaaggagcttaggctaataaaatgattcagagcccagaaattggaaaacttgggttgagtgacatacctatcagtttctaaccatactactttggtcaactcattcaagatatataaggttgtttttagttgacagagttaaaaatttcatcttttatctcacaagtaagctcactggggcataaataatacaaagcacgtaaaagggatatgaacattttataaggtgtgaagaatccctcttatacataagagcataacacattcttcagttgaagcaatagagccctttcactacctgttctgggaatggctcaacttatgtagcacttgctcttgtctttccacgaacacaaagtttgcagctgaaacatgaaacctctttcctgcttcccaatctaccagattttcaacatggataatataacataaaggacttatctgtctgtaccatagaaataagtagtattttgcctggctttccaagtcctcagagtctcaccataccctatttttctcagaatttcattgccattttggggcaatgaattcttttgagaatatgattgaaattctggatcctttacactatgtgtacacaaaaatgtttggagattgtgttagcgggattgtggacgctattatgcacatttaacaaactcttagggttttataaactgtgatgattgttataccattttatttatctgcaccggcttatcattacaagctcagttaacattctccatccttcagtaattagtaatgttagcccgtgtctttaaaaaacaaaacaaacacatatgtattgaggtatgatgtcctctgattatatatcttaatgtagtattttattttatagtgtactatttaccagttctgccagtgttaatcattgtccgtaattagaatattatttcctatcttcagttttctctattaaattgtgatttttgaagaccatgtcactattttcctgattttcatttattgaaattgaaaaatatatgtaagagtttttcatttattgacatttaaaaatatatgtaaaagagttttacatttttaaattacatgttttatttatttttgcatgttttaaaatatgtaatttcactgacaaatgaaaattcagagaaatgaaactcctataaaattaattgaaaagagtctagtgtaaaatattctgaatataacctttgttctaagtacatatatagatgtataaccacacaaataatttattttttcaaaaccagtcacaatgttgtcttagctacattttcagttatttaatgtattgtaaaaatatgccatgcaattaaactcttttatatcttaactttgtagtggcttcatggtattatatcatttggagatataatttatttaaagaaactaacagtatattcacatgtgcatatttccactgaacacacattaatttcattaacaaaaagaaatacaagaccaaagaagttgacctctaaactatcttcctatacttctaatgtgaacactattcaatcatctcataatttaaattaaaatgaaataaactacataggcactggaattttgtttctttctacctcttaaaatttggaatgctcccttaaaattaatagattccaataacttacaagaaaatacccacctttacacaaagttactataaaaatccttcatgtgtgattaaaaaataatatttacatgtttactttgtgatcagatttatacttagcagctcaatttttagaataatgatatgaggaaataactattatgaagccattttatcaaaaaaagagcaaaatatcaggatctcaaagagctattagcactccagtgctcattatagcacgattaaaaatagtcacgatgtgggaacaacgtaaatgcccgatagctgaatggataaagaagatgtggtaaatacatacaatggaattttattcagtctttaaaaagaaggaaaacttgcaatatgtgacaagttggatgaaccttgaaggtatattgtaaatgaaaaaagctagacacagaaatacaaatacttcatgattctactcacaccaggtatctaaaattgccaaactcagagaatcagagattagagtggtggcttttagaggctgaaaggaggagaaaatggggaaatgctaattaatgggcataaaattttcatcatgcaagatgaataaattctaaagatctgctacacaacgttgtctctaataatactgtattgtacacttaaaatggttatttgataaatctgttgagtgtccttacagaagaaaagaacagttttaacaaatgttttatgtatcacaaagcagatgatgatgccctatggtgtttcttgctaacaattttcaacacattttttatgtaaggtgaaatgtcaactaaaatatccaaatagacaaaagtgagcacaatgtgcagtaatataccttaagtcacacatttagtaagtagcagaaccagaattacagataaaagtcagactgattagcaactgtgtttgcgtgtccgtgtgtgtgtgtgtgtgtgtgttgtgttgtgtatgtgtgtatgggtgggtgcctacatgcttagtatattttaatctcctaaaatcaaagggcaactgtccaggccaatatgagtacattctacgaaacaagaataaacactaacatgtgatcccttctctactcctccctcattctctcacagtcagagttatattatctttccctgccccatgaccaaaaaagaatctgtgcttttcacattctgtcctttgtgaagagaaaatttgactggtcaacataaacttacgcacgttgtcactcctgtgaataattctaataaataaatgactaggaactttgactccctccttacaactttggcaataaaacagatttttaaacatataatttgcataagttaatcatgtaaatataaaaatttaaacataaaacaaatgtactgaaagaaaaaacaactattatgaggtcatgtataacaataaaatcaccactgataaacctaacacactaaaaagtaagataagtctcaaagtcactggaaaaaaatatgtaatgaaaaatttaaagttataaatcttacaaaaatataggacagtgcctaattatctgagtgattaatattgctaggtatgctaggggagatcagccaatgcttagtccagtgttatagttgagccttttgtatttctacagttatatgttttgcttcatgatatggtataattggagttattccacaggggaagttaatagaaggaaagaataaagatcagaacaaaagtaaataaaatagaaactagaaaaacaatagaaaatagtaacaacgaggttttggtttttttttttgtgaaaagatagactggcttgttcttgacatttactgattccacaatatgcaattcagatttagtaaagaacatttactgaatggaaattgtcacccaactctttctggttttttgtccttgttaagtgaatgaacaaaattggcgaaaaattttatgtccgaaagttcttaaagtctaggggaaacatttcttatgaactaaatgtaattcaaaaacatttaacagaaggaatcttaatgtcaggcagtgagaaaaaatagaaagtcaaagatctctaaagatgggggtgatgaaaaagaaaaggaactgccttttatgaaaatggaaatactattttgtttactggggggtagatttaggtaaataataaaatagaagttttaattggcaaagcgaaaaacacttaaaacatgctgaaaaagaccacgtcaatcaattttactcactttaaacatgtttttttcattcccttttcacagtatactgagactgaaactgacacaagaaacgttcactaaattgttgatgttcgtttcgctctaatatttgtacttttttttttttttttttttttttttttttgagacggagtcttactctgtcacccaggctggagtgcagtggcgcgatctcggctcactgcaacctccgcctctggggttcaagcgattctcctgcctcagcctctgagtagctgggaatacaggcatgtgccaccacacctggctgatttttgtatttttacttgagacggggcttcaccatgttggtcaggctggtctcgaactcctgaactcatgatccgcctgcttcggcctcccagagtgctgggattacaggcatgagccaccgtgcctggcctaaatttttgtactcttaaaaaactaagctatcatattgattatgaccatgacacatatgaccatgaaaatatttttctaatatttaacgtaacgtttagaaacatcactaagaacttcaaatacaatcaaaatactgactttgaatattgtttttttcaaaggcctgacgtttttgtccaacacaaataagactgtcttcacaactggtcctcaggcactgagtagagtaagtttctccaagccaaaggctgtctataaatcttaatctacttttgtacactactaaaatttcctctcatggaatggtgaaaaatctccaataattcttatgctttaatttattgagaaaaacaattatttcattcaaaattaggtattacatctcaaattatgaatgcccaatatttgttaaaagactcatatatttaatattacttcaaaaattagtgaaaactttatataagccaatattttcaaaatgtacttaaaaatagaaatttcattttgagcctcaacattgtttgctgtctctctccccccatcaactctccttccacccaccccaacctttctccccagcacacacacacagaaacacatacacacacacacacagtcaaagttgttttgaacagaaaaccctcaggctacgccccttatatttgagacgggagtgggggtaacagtccacagctgctcatctacttctggtaccttctctagccttatttatttcctagttacatattttacatcacttttcactgatttcttctccatacattttctacctttgaccagtaagtgatagttttcctctttatctaatctttttgctattaggcgataaagaatcttagagcagcaaagattccaaaatatctgtttcgtccatctcttaagcatagggttatttccatggctttagtaataccatttattgaaatcatgtcccacctaaagtattttcattcttttcttatctaagcctcgtaaaaagctctgttcaagatgaacttactctatggaaatcttcctgagtacgagtcgatggaccattgtaggatgcataaactgccgattcttggatcccattcatcacgctagtaataagccttatatatccatatttgtacgatctctccaatcactgaaattagtttggaaaaatcaaacatgtgtttgaaatacaaggtagcatatcccaccttgtattactcattcttttatacgtaactcttctattacgatgaggttgatgggattaataattcatagtaagagaaggaagatgacgtaaaactgtgctgcagcagggtttatattgcaggacctgcttcaaaaccctgaacaatatattagattcacgggcagctgctcccttaagtattgctgttcactcaactcttagaatatacaatacaatcgcaaactggggcatataaaagaaacgtgatgctttcattcatttgatcaatatgctttatgtacctagtatatattctagtccttttcctcttggagtttttactcattagggaaaaacgacctgcaaatatcgtaatgtcagtagtgataactacaatgaggaaaaaaattaaagctttgaaagaagacagaacaatggtagtggcatatcaaatagggtagtcagaaaagatctctttgcagtctaaggtaaaggaagtgcgccatatgaataactgggggaaaaacccttccaggaagagggagatacatgtgtaaagtcactgaactcaaagtatgcttggcgtatttgatgccaagctagtaggccagtgtatctggagctgagaaatggggttaagggtaggaaagaaggtaggatacctatagggaacaaatcacgatggtgttttggattttcttccgagtgtaaagtgaaattatttcaggatttagaactactctcaacatcttctctacttactcagtttgtaaattccttaagggcaataatatggccatatatgttccccatgcttggttcactgtctctcattccataatagttaccactattccacaagacccatcgattagaattatggatttaaggcttgcaaaggagaagaaagctcatcttagacagctatatggttccagtacatagtaagtgaacatattaataagccatgtgtcccgtgaccgactgccttttacaaccagtctcattaggtagtctatacttaaacactactctgacagagggctcactatcccccaaagccttttattgcattttgagacatttctattagcgagtattcaaatatcacatatttgaccccatgaattttagcaagttaacttagtttatgatttcaattttggaatttaattttttatgcttgaagagttcatatcaaaaaaaacaaattttgagagcatggccatgtttttatttcatagttcattttgtccttagatgtttctgacaacataaatttagcagtgtagcagttattaacaccattcatatttatttccagctttctacctttgagacatgtaatacgaatatatttcttagttctaagttgggtgagaccatgtaactagttgtgctcgtgagttgtgaactgaagcagatatgtcacttccagttcaagcaattaattgccagcacaagacctttcagaattttctttccctttgcggagtgactgggagtatcctagatagtagctgtttcatcaggctgggtttccaaatgaccacaatgaatagcgttcccttgctgattcacagtgcacattggaatgaaaaagttattataacatagtgaaatttaataaccagatctagaatgactggtttagatggcacttaataaacattaagtgactagtaacacattctaacagcagtctttaacctgcatattgtgatacattagtaaatctccaaaccacaattgggttatcatggtaaagagctttatggtagtttctaggacatactaattactcaataattttctattgaaagaaggagtggcgattcctcagggatctagaactagaaataccacttgacccagccatcacattactgggtatatacccaaaggattataaatcatgctgctataaagatacatgtacacgtatgcttattgtggcactactcacaatagcaaagacttggaatcaacccaaatgtccaacaatgatagactggattaagaaaatgtgccacatatacaccatggaatactatgcagccataaaaaaggatgagttcatgtcctttgtagggacatggatgaagctggaaaccatcattctcagcaaactatcgcaaggacaaaaaaccaaacaccgcatgttctcactcataggtgggaatcgaacaatgagaacacatggacacaggaaggggaacatcacacactgggtcccgtagtggggtggggggagggggaagggatagcattaggagatatacctaatgttaaatgatgagttaatgggtgcagcacaccaacatggcacatgtatacatatgtaactaacctgcacattgtgcacatgtaccctaaaagtataataaaaaaaaaaagaaagaaagaaggagtgaatgtaaccattcacctaacaagaagtttttgagacatattgcctcaatatttcaagggccactgagtaataatgacttatttgtttaaaaattaagacggtaaaaatagtaagttgttaaatttccaatgaaaaaaattgcaccatagaagcaaaagtgaaatgttatagcacatacaaaacacacacacacacacatacatacacacacacacacacacacacacacacacacacacagtgtgtatacataatggatttagagttctagttatgaggatgagactagggaaataggcacagagataaagtgctgttagagacaacccatatgtataacttcgaatagaacatactccctatgtaagtgtttagtattattggtagatatgtgtattgctgtatgtatatacccacacacacacatatatatgcacacgtaacacacagatatatactctatttgaaaactttgcttataatctaaccatgtatcagtgctatctttacagcatggtattaagtatataactatagcatgaattttaaagatttcatgatattgcattaaaaatatttaccctaagttttattaatcctatggtgatcactattcaagtgtttattaaactttccctctttgaaaacctgttttaactatgtcttacatcatttcatttaccagattattactcctaaatttaaattttgtgattaaaaaattatgcaccagaaggacagcatcaatttattctgtcataagccctcttacaacttttgatgtttcctgtttctttatgttctgcaaaattatcagtattatcactgtttcaatctgcctatctggtagttaaaaataatttgattgtttatattatatttttttattaagtagatggtatgtctttttacatacttaatgatatatgggctttttcgcttttgtcattttctggctcatgttctttatgaattttcctattggggcattctagttttacttattgatttatcagcattatttatatatgagggctatcaatccttcgtatgttataaatgttactaataattttcccaactttatatttgacttctaactttccttagagtctttcttaaaagcatcataaccaatacatgatgcaagaattgccatactaaattcctttattgactccataaataattaactataatcatgctctatgaagcaatagaaatgttaagatttttaagagcttataaaaactttatttcacatttattcctggcttctaggatcaagtggccaataagcaattattaaattaatggtaatactacagtgcttccggcatacttgttcctgaactatttgaggtaccaaatagttaaaatgactttaatcacctagctcacctgaaatttaaattataaagtagaagtagaagaatccacgggctaatcttatttctcattccattaatgatctaaatttcttcttgaaatgactttttcaggtattataaagtaaatttgaatgtttcagaaagaggactacatatcttaggaagcagataattgccactggatttagcaatctgacacacaatatagaaatttctaattaaagttctatttttataatgctaatctttcagccaaaaatttccttgggacatgttataatgaagataaaatgtactaagattttaaattgaccagagttcccagagacacctaataaacattttcataaatattcactataagtaagttttattgtgaagtaatcccattgttatacatacctctcatcattggcatcattacactttaaataagttacctaatagaagtaagtatttaaaatgctaagcttgaaaatctggatttgctacacataaaagaggaacatgactttatgtagctgaattggtatgcagatgatctagaaatgaggagtttcataacgataccatcaactcatcattaatccttccaaagatagtttatttccccaaagatttaattgatagcattctcataatttaaaaaatgactgtatttctattaaactttataatgaacaaaatatgtgaccgttaattatgtgttgattttaaagtcactctaattattactaaataaggtatctcttcaaaagaattaatatttttctttacattgacatgcttaagggggtaaactcttagtgaaaacaaaaaagtttgctagtagatttgagacccacatggatttaacacatgtatgacataataggaggctctgtgttaatctacaagtttggtaacaagtttatgttgattaaccaagcattattacattttttcactgatattatttgtagataaagaccacaatatgcaaggatatgtgctgccagaattctatagcagggattaaaattaggcatgggtatccactaattatacattttaaggaatatatctgtatggccgggcacaatggctcacatctgtaatcacagaactttggatggccaaggcggctggatcacctgaggtcaagagttcgagaccagcctggccaaaatggggaaacctcgtctctactgaaaaatacaaaaattagctgggtgtggtggcaggcacctgtaataccagctactcaggaggctgaggcaggagagttgcttgaacccaggaggcagaggttgcattgagccaagatcgtgccagtgcacttcagccggggcaacagagcaaaaactccatctcaaaaaaaaaaaaaaaaaaaaaaagaaaagaaaagaaaagaaagaaatgtatctaagttttcattttcaatcatggttgtcatgtatcttaattatgatgttacaacactttgaatatagtttcattaaaatataaggttaataatttaaagagaaaagattaaaaatattaaaatattttctgaaaacaaaatagattgtaataaaattaatgcaaaaaagaaaatcaaattacttaatgaatgtagaaactagagatcgccctacagaaaatgtgacagtgtgatgaattagcttaaaataattataatccttaagaagacatcatgtttaacaaaattcaggatatcaggatcctagaccaaatatttctgctctgtaatcttaggtacatgacttagcatatctcagcttgagtgtcttcacctgtaaaatgaaaggtgtagaggtttcagtgtctacttaatattcttggtattaaattacacatacaaattatttccaaatggatttgaaatttcatttgtgctagaaagcaattaagtggccatttcggctcctactctgtgacacttatgtgcaaggacattctcaaacttcttaatcaggagcctggatatttgaagatctgtacaagcttacctaaaacaagtacagtcatcagtaagtagagtgcactttattgaacacctgttaggcaccatgctagccacatttcccaactaacctggattcttcagaagaatcttgtaagttctgacagattgtatttttttaagatggatacaatatgtttcatcttacatgttattcttcggatgtaacactgatacttctccatcaagagttgggtttatgtttctgccccttgactaggatggacccctgactatggaagaagttatactatgtgacttccaagactaagtcacaaaaggcaatagagtttctgcttggtactctttgggtcacttactcttggaatccagccagcatttagtgagtgactgcagattaaataaggccacatatacatgttccagccaactgccctggctgaagttccagcagtagccaccaggcatgttagtgaagaagccttcaaaatgacttcagcttcatctactattttattacacctatatgagaagccctgaacccatctgagacccagaatcaaaagagataataagaaaaacgaatgttgtttttataagctcccaagttttgagttgatttgctatatggcaatagttactggtgaacaaggtaagcacacctgtattacacaggtgagctaagcattacacaggtatgccaagagataactgagtcacacaactaaggtcaatcagttgtaacacgaattcttacttccataaagacttgatttgtaaaagaaaaataataaaacataaaaataaaaaagtattaaaataaatgtttgaaaaagatattccttaagaggcccttcctaaagaaggcatactgcatctagcctacatgtggagatccaaacaaactattaatgattacaaataagccgccctgacctgcttaaacaccggaacacagattagctaaattccatccaataattcattcaaattctaggaaccgacaaatcccataaaatgtaataaacatgacttaaatgagagcattcaaatatccttggttcgcaaaaattgactctatttttgtaacatccacagcaatacctctggacctatctctggtatcaagagacaaaaaagtcattttctagaatggttggtaaaattatatatcatctcttccagaaactccaaatatctttaccaaatgtaaaaatggactttcattctacattttttgacttatatttttaagattacattatcatttataaatataatgcaaaatggaagagtgttgatccacgttgttgtaaatatttctttacccttaactacttattgaatgcctgttgtgtaagaaggtgaatggagtctttcccctctaacactctatgtgatagtggaggcttttctcacatacactatgcattaattattttagccaccccatggaaagttgaaagtatctttattttagagatgagaaaactgagtaatagagagaaaatagcatatgcaggtcccacagactagattcctattatactcctgttttcatcttaatatcttagctatggaatattccttaatgttcttcgaaaagtttaacaccattaaaattcttatttacatcaaaataaacatgaatagaataattcagaggacaaaacaggaaatgtatttgggacatggatgacagaaaatttcctattcttatttagaattatcacttatatgtcaagaagaaaaataacattcccacactattcaaagctttttttaagcatcaatttcctaacctattttgataggtaactccatttgtggagttacatctttgtaagatttttttgaagatcagaaataataaatgtaaattacatgctaggcatttaacatatttcctaaatgcagacacacctagtggaataaatgatgtattttggttatactatccttataaaattttcatacttaatgagggctttaccttaaataactttttgtttttaagttacttacactaaatcatttttttaaaaacctctaggtttttggactataacacaataacgctcctttaatcttcataaagagaccactatgaacaattttacaccaagaaactgtaatctaaaaacatggttaaattcctagaaacataaaacctaccaaatctgaactgtgtaaaaatggaaaagtctgaatagatcaatacaagtaagggattgagtaagtaatttttaaactctcaacaaagaaaagcaaaagacgaggtgacttcataagtgatttctatcaaacattttttaaagaaaattaatgccaatgcttcacgaactctttgaaaaaactgaagtggagggagcacttccaaattcactttataaggtcagcattaccaaagccagaaaaagacatcccaagaaaactgcaactcaatatccttgacagatatagaggcaaaattctcaacaaaattctggcaaattttaacaacacattaaaaggatcatataccatgaccaagtgagatttatccttgggatacaaggatggttcaacatgaaaatcaattagtatgatacaccacgttaacagaataaataagaagtcacatgttcatttcattagatgctgaaaacttgtttggcaaaattcaacacaatttcactatttaaaaaaaaccattaaactctcaacaaactaggaatagaaggaaattgcttcaatgtaaaagccatatataaaaagatcgcaggtcatatcacaacaactgcgaactgaaaggattttctatgaaatcaggaacaggaggaacaaggtaagtatgcccattcttgccacttctaccgatggcaatactggaagtccttgctagaataattaggcaaaaaaaaaaaagtaaaggtatataaatcagaaatgaagaatgttattcctatttgcagatgacataatcttatgaatagaaaaccctagaatccattaaaaacactagaaccaatttaaaaatcagtaaagttgtaggatacaaaatcatcatacaaaaattagttgagtttctaggagacaaattccattcacaagagcaccaaaaagaaaacagtaataaactaaagaggtcaaagagtatgtactgaaaactataaaacattgatgaaagaaattaaagatgacaaaatcaaatggaaagacatcctacattcatggatcgaaggacttaaaattgtcattacattcaaagaaatctacagaactaatataatctttatcaaaattccaatggcatttttcacagaaacagagaaaaactctgaaattcatatggaaccacaaagaatcccaaatggctaaatcaaccttgagaaagaagtacaaaattggaggtatcacacttcctgatttcaaaatatattactaaactacagtaattaaaaataaattgtattgtcatgaagacagacatatagaccaatagaacagaatagagcccagatataaatctacacatatagggttaactgatgttccacgatagagccaagcatacacaaggaggaaaggataatctcttcaacaaatggtgttggaaaaactggatatccacgtgcaaaataatgaaattggtgcttatcttatgccatatgcaaatatcaactccaaacggataaaatatgtaaatgtaaaacctcaatccataaaactcctagaagaaaacattggaaaaatcttgtgacattcatcctcgcaattatttccaaaagcacaagcaataaaagcaaaaaaaatagaattaagactacataaaactaaaaatcttctgtttagaaaagggaacaaatcaacactgtgaaaaggcaatctatggaatgggaaaatacaaaccatatatatatattatgagaattatttctaactcagagctattaggagggttaaataaaatgaattatataaagaatacttcatggtatagctacattctaagttatcaaaaagacagcaaccaatatcatgattactattttaaatacatcagggcttaggtaagattttgtgatcagacctgaagaccttatattatattaacaactggttatcttctaaaatatataaagaattcctacaactcattggcaaaaaaaaaaaaactaaaaacgcaattaaaaatgggctaaaggcttgaacagacatttctccaaagacgacacccaaatggtcaacaggtgtatgaaaatatgttcaacattatgaattatcagggaaatgtaaatgaaaagcagaatgagctatcacatttatacctgttggatgcctactattaaaaaatggattagtaaggatgtggaataattggaactattgtacaccgttggtgaagtaaaaaatggcatggctattatggaaaataatatagttgctcctcaaaaattaaaaacagaactcccacttgatctagcaatctcacttttggatatttatccaaaagaattgaaatcaggatcttgaagggatacctgcaatgccatgttcattgcaacaccattcacaagagccaagatgtggaaacatcctcagtgtccactgatggatgaggggataaagaaaatgtggtatatacatacaagagattactattaatattcaaaaagaaagagatcctgccacattaacaacatggatgaaccctaaggacattatgggaagtgaaataagacagtcacataaggacaaacactccatgattctacttataagaggtatgtaaaatactcaagctgatcaaatcagagagtgaaatagtagttgctagaggctgtggagaggaggaagtgggaagctgctaattaacgaaggttcagctatgaaagatgagaaaattctcaagatctgttgtacaacttgtacctatactgaacaatgctgtattttacacttaaaaatcagttaagagggtgaatcccatgttaagtgttcttacacacaataaagtaaatttcaaaagaagttaaacgataagagtgtaactgttgaaaataacatcatcacatatattcacttcaaggttccttccagttttaaaattctactcagaagtcttcagtgtaccaatttatagagttgagctaaaacctaacaattctgtttctgggtaatttgttcagtcacatcaggatgtataaaggcttcctcgaagcaaattagtgatacttttaatctaaggagtggtctccctggctggcttcccatcctctgtttgccaattactttctacaatatgtggacagtctgagggacaagttgtgccaggagggggcaaaggcagagatagagtgaaaaatctcctctgcctcatcccctcccaacacaggattgctggatgtaaaatcacccagaagtgctttttctgctttataaaaggcattactatgttctgctctgcatggttccaagattgttcctcagcaacctcagaacaaaaaaggatatccttttccttagaatcttttactcggtatattaacttgccgaactctatacaggttgtgagtttgtttataaatcagaatccaggctatctcttctcataaaagtgctaataaaaacataaaaattttctcagatcagaccacaaaatcttatctaacccctgatgtatctaaagtagtaatcatattggttgccgggttttgagaacttacaatgtgcttataccatgcaatgttctttataaaattaatctcatttaacactcctaataactatatgagttagaaacagtttcaataatacacatgaggaaactgaggcccagagttcaagaaattctctgaaggtcacatagcaagtaagtaataatgaaggctcttaaaagtagatgtaggggggcagaagagtataggtaagagtgatgtcatatgagaaagactcaatttgcccttgttagctttgaagttgaaagggggcaatgagccagtgaatgtggtcagcctctagaagctagaaaaggcatggaaatggattctcctctacagcctccaaaaggaaggcagccctgctgatatgttaatgttagctgaatgagacctgttttaaacatctgaactaaagaactgtaaaataatgaatatgtgttgattaggggcactaggtttgtagttgttgcatcaaaaatcgaactaatacatatagacacatgattagttatcaggatgggttaatttaaaagaagtatgtttttgtccctgtggccatcaactattcagggtagtgttttgagaccgagtcttgccctgtcacccaggctggagtgcagtggccgatctcagctcactgcaacctccacctcctggcttcaagcaatcctcatgcctcagcttcccaagtagctgggattacaggtgtgtgccaccacactcgcttaatttttgtgttttcagtagaaacagcattttgccatgttggccaggctggtctcaaactcctagcctcaagtgatctccccgcgtcatcctccaaaagaggcgggattacaggcatgagccactacacccagctcgcggtgtagtttgtttttttaagtgttacaatgagggtagccttcacttttactgtcgtttgaacctactctaatcagcaacacctccaaatacacacacatgcacacaccactgaaattgttcttattaaaggggatataaactagagagagcatgtaactttatcggtcaaaatgggaaagttttaagagtgaataggagtgttagtaattccactgtagtaactgctatatattaggatttcccagacatcgtaccctactgttttcctaaattcactgaataattttcaatcatcatgttatttgaactcatcagcaatatttaatgtagttaggtatcttcctttctctgaaaacactttcttctggattccagaatgccacatctatcttctcctttttctctcccctttctagccacctttttcagcccctttgctgatgcctcatcatatatacatctagagatctcatctgtctacacatttttccttggcaatcttatcctggccgatggatttaaataacatctatgtgttgacttctaaattattatcctcaactctgatcttagaaccccttctttacatgcattcatagcctcataggcacctcaagattaatatgtttaaaactgaaatcctaacgttcactcccaaacctgttccttctacagtctcacccatcttggtttgtggcaactctatttggccagttgcttaagtaagaaacctcacggtaatccttgatttctctaattatttcataagtcacatctactgcatcaggagggaaatgactttgatgaaatattggcctccaattctgctaccagatatgctatgctagaggatcatgaaacagaaaagctcacagataaaattaaaaggctcatatcataccatttattttttttatttatgtatttttgagacagagtttcactcttgttgcccatgctgtagtgcaatggcatgatttcaactcactgcaacctccacctcccgggttcaagtgattctcctgcctcagcctcccgagtagctgggattacaggtgtgcgccaccacacccagctaattttgtatttttagtagagatggggttttaccatgttggttcggttggtctcgaactctgacctcaggtgatccacccaccttggcctcccaaagtactgggagtacaggcatgagccaccacgcccggccttaccatttattaaatgagttaaaaacgtatggcatgagggaagacagcaggaggataataaaattagaatactttcagacacagattgttttgcatgtttatgtgtcacttgcttcaataacagtacctggcacataataggtgattcaaacacaagcgctaaataatcaaatgtatgaatactgctctatgtgtgcgtaacgcaatatataagaatcaccgtcgagaaagtgcagcgtcaccctactataatgagcatgggcatggagttgaataaatgcaaatttgaattcaggttctgccacttactaattaggcctagaaatacaaattaagttggccaatttaaaacagagacaaaagcactctgagctaagggaagcataaaagctaatatggaaaattttggggcacctgtgtgggagaacgagtgatgtaatttggttgaaggaacatgaaatacgtgtgtaatgagcataaaaatataaaatattaatatatcataaatcttttcgaggcagtttaggagagtagccttgttatatggacaaaattaagcgaaaaaaattgtattattagggctctgaataacattaaaaaatggacaagaaacttcataataaacttcacttggagacatactaggtttgagatattagtggatatcaaggtatagatacatacaaagagttgaaaattaattggaaatgtggctataactcaagtaagattggaagtggtgaagacagagatacaatgatcatttgcatacagattgaatacagattgaagccaggttattaaattattattaaattatgttgataaaagaacaagtacagagataagaatgccaagatatttcccatgagtttcataagctaaagaagttggaagaacagaaagagccaggtaatgaaagacacagaatagtcagagaggaagaacccgctgagtgtagaggctgagaaaaatgtttcatcagtggtagaaagttaggagagctgaataaaagccatttgtctctgtgattaagaatacttatttgttgaataaataaatgaagttaaagcagagtgatgtgtctggggagtgagggcatgcacgtgttttccataggggacagtcacccacatggctctctcctcttatagagaacgttatttttctctgtagaccagcaagtaaacactttaataaagctttctgatggaatcagatccagcctgtcttgagttcctttgaagtagagcaggtacagcctgtaggggcagtgaaagctcagtccttttgacacttttgaaataaatgttcttagtgtgaataattaaggcatacacttatcaaacctaactacatgtaacatcatcttctgatatgcttcctttagtgacagaatatatcattccccatcccccatctcttgtgatttgtgctgtgtcttttttaaatgataaacattacatttatttgaatggcttattttaaataaaacaagtaagtgaatttgttgaattatctgtgatttatgacatattatgtatttggtaatatttacacaaaggtagaatgagcagagcctagcaagatgtaagtccatttgtaattacttcattaaggagtcatacctgagcgatgccttaatgaaggtggtgatgaggtgaaaatgtgctaccagaataggcattggagaaaacctagaaaaggcagctcaataaagtgataatgagagggggaaaaaaacccctatatctttgcttggtgtatgctccttaatcttaggaggtggcacttattccttaagtcttggtgatttcaacggagggaatggtgataaattgagtctagagagtcgatggagagtcaagaggtccagaatgagagagagtgagaagagagctttgcaagtaaactagccaaggatggaggtcataactatttcaaagcttagaattttcagctaatgcatcgattaactgccaaataaattactaattaaatgcacaccactatcttaacaaaaaattgagtctccaaaaatgtacacattttttagccgataggatcaggtctatcatttttaaactcccattcatagtgtagttttgataaaaatcacatcctctagcacgtttcgaattggctccattgagcaaaataaatcatttttgttaaaaagtaattcttgcaaatctagcaatcctagcacatttcattcccacgctgtaacatttataaggctatttcttgtatattgggttccatacaatattgaaagggtggaaaactccactgagtcttcctcatatagaaagtactaaacattgccgagaatatgacctggtttcagtgtgactttttcttataaatactacagagcctgctatacacaagtttaaattagcaaaattaaaggagagcatatgaagaagcttgcagttatatttttcttacatagaatatatattttagaatgaatagataaaataattcacttagaatgtatgtatttcctttacgtagatccagaaaaatctccccaaatagtgtaattagcaattttcacagatgtacctacacttttcgaagttacatatataaaacttttcatgagcctcatgttttttataaccattagcagcctttgtcaaagagaaccttagaggttattacataatgaaagtagaaaccattacgggaattcatatttatgaagaatcaacgtatagtaaacctagagaagactcaataacaaagcagaatcacatgagggaatcaataaaacttggaaaaacaaaccagctcttcacgaggagataaaaggcactgaaaaattcaagcaagtaaaagcagtgttagattatcttggaagcagttctctggtttgtacaacagagagtaaatgttgacagacctgtgaaggaaatgggctccgtgtagggtcagaggtggtgacataagcagcctgtgtgtaggcatagctcttgaatcgaggcttaggggaagaagttctctcatatccctgtgctagactgaccgtgatctgcagagaagggtttgggggagtggatagagaggagggggaaaaaccataagtaacccgaaaggactactttccaacatggtagaaaacagaacattaaatggaaatggtgagattcaatgtttaatactaaacatatataaatgatattcgaaattggtatactcccagaatgaaggcacttaatatcatgttggagagtaaatgatctgggaagatatgagcatgctatttagccatgaggattccaaagtaacacaactccaacatttatatgggatggtactcttcaatccggcaaaaacaggcatccataagcaattttctctaaatccaaagtaaataaaaacagaattcatcaggtccataccctggaaaggactaaaaatttcataagctaatacagagctagctcagcaaagtgagagagtttggcctaagagctctccacacattcagcagaaatgttgctaaaggtttcttcactgttgtttgtgcctgagaaagcataggaaaacatccaaaccacccactgttgagagaaagaacaagccaatgtcatggaagaaccccactaaattctatacaattatgtaacgaagaatttcatcatgtttttctttattgtttatttgaaatagtttaaaacacttttctattttcaaaattgttatcctgaataatcaaaatctgactttgtacatcatattgtcataaagtattttttaatgattaaaaactgtatttgcctttaatctttctctagctctttgttctagttgatgaagattttagagtttaatatgtacgtaagtttgcctttcatttcattgtgtgttacacaatggaaatttaatatattatgttctatattcctatgatatggtacatatgaatagtatttttaaaatatgttttgaaatgaatattgtagtcaatgaagcaaaattgaaaaggtttagtctgtctctttttgtacatatacatacattaggctttgtatatatacacgtgtatatacatataagttatatatatatgtgcacgtaatacctaaaaatgcatataaaacagaaaacatcttgaatagtagctgtcctttacacactttacctgttgagaatagtgcatttgatgatgtaactgaaaatgttcttctttagtcactttaggtggccttggcaacatttccacttcctggatggcttcaatgctcacttgttgaggcaaaacttggaagagtgatgtgatgtacattaagatggacttcttatctggataggtggtatcaacatctgtaagcacattaacactacacatcaatttttggtttctatatttgagactctaaaaggataatgaacaaatcaaagttaaaggaagacgatagattaatgaacagtgaattgtccatgaatgtcctccagagactaattagaacatgagaatgaggcctaaaatgtctttccaatttggcagaccaatgagatgagcagtaaagttaatttattttccttgttcatataaaaacttcattccatattactttttcctaagtcaaattgccaaactagcccatctaacagagtagctttcattagataagaaacaaaaataaaagattacattttccctccaatggaaagttatattaacatgtcaattcaaatggtgcactggtaattaaacaaatacacaaaatggtttaccgctttggttctcagtaaagaaacctgataccttttaactgaatgttgctgatattaaagtatgcagagagctaaataagtctctgctgaaatgagtcatgtatccacaatataaattaaacagaaaaataccatataatgatttttactattccgtgtatgttaaaaatatttgtttacattgtggtgcatgggataaagtagaatatcactttccttctcagacattagagacaaatgtaaaagtcccgcacattaagttgatctgacttcatatcctttgccacatccagaaagtgaatgaaacgcagcatttaaagtcaataatactttgtaataacacatataaagtggcagctccttcaaaagattcatttgctacttggcattaaaatttacttactgcactcattccagtgaaccaagatgtaaagtaatcctttatgtgaagtatgtcattagtactagaaatgttaacacataagttctgactatgaaatgctagcatttcattgtcatcctttttcatcctttaaaaagaaggaaattttgtcattgagacagcatgtgtaaatctggaggatattaagtgaaataagccaggcacagaaagataagtaccacatgatctcactaacacatggaatctaaaaagttgaattcatagaagtagagagtagaatggtgtttaccaggggctgtggggcaggggttgggaagatgttggtcaaaggacacaaaatttcagttagataggaaaaataagttcaggagatctattgtacaacctagtttataacaatgtattgtattcctaaaaattgctgcgagagtagatattaagtatactcaccatgaaacatgctaagcatatgaagtaaaacatgtattaattagttcaatgtagccattccagaacgtatacatatttcaaaacatcgtgttgtacatgataaatgtatgcaattttagttttttaatcattaatgaatataaaaatcaaagataaaagataaacataaatcctggcaggaggtcaaggtaatgtggcaatgtattttccttgccatacaatttatcttagcttaactactattaagatatctgtattcagtatgtatattctgatcaggtgttctgattataagtgaaaaagccaagagtaaagtctcaagtccgttagcacaaaagcaggttgaacaagtgacttcatcaattcttttgcaagtatcagaaccatgattaatcagaacagctatttttaaagtatttttaaaaagagttacaagagacgaaaaaattaatgttccttggtctacttctatccgtagaacaatacagtgcttctcaattcttaatgtacatatgaatcacctggggatcttttaaaactacagaatctgattcaatagatcggggtagagcctggagctctgcatttgcaatagtctcccaagtgatgctgaaactgctagtctgctacattttgaataagggccaaaaacattacttataagcagactgttacatcatctcccgttttattgttttattcatttattcaaatgatattagacatttcaatgcacaaggctgaaaggtacaaagttatacaacacatatggctcaacttattacactttaattattaatcaacagatggtcaaagtaatttttgcaagtactttttaaagaagaactaaataatattttgtgcatgaacactgccttccttaataatcttacaaacttagctttggaattctgaagcctagaaatctccaattcatttgataattgtttttcaaaatatttgaccaattgtttcttatatagtagatactatacttcaccgtatcttgaaattctagaaaatgttcttccttctcactagtaactagtcagctgtacctgtgattagcataacttagagctctttcatttttagtatattaaataaaaccatgatgtgagaaaacaaaaagggttgagcctgtgcctattcactgctgtgttatacatagacacatgcatgtatgtttggtctcaaatatatgccattataaaaagtaaaaaatggtgaaaaattggccaagcattatttttattgccccccaaaaaatttcaaacattgtaataaatttcatttacataaaacatgtggactaaatgcagctgttcataaatatcagtcattacaataaatatgcacttatttaaccaaactattgccattttgccccaaactattactatcccacttctgagattatgtggaattcaaaactgccagtaggtagaaataagtaatttttgaagaaaggaatttaggtcttctaaaatattttgaatttcatcaacatacattttcaagaaatctattatattcaaagtattttaatggattatccaggaaatttgaaagatagaaaattcatgaattctgcttctaatttggaataagaaagtaaataatagaagtacaaagtaattgcattgctgaacagaatttaaaatgtgttcctctaattggcacaaccagttgtttaacatgttcagatttttaaaatcatataatattggaggataaggcaattctctttaaataggaaactgaattaattatgcataggatttcaatagctggaaatgagggaatggggaagagtattcggggcagtgggaatatgtagaataaacatgcagaggtagggacacattagcgatgtcttggcaacagtggctttgtgtgtcttagagagagtagagtagtgaaaactaagatgaaactggtagattgtacatagaaaactgagggatcatcaacagcaaactagaaaacctggccttcattcaatagactagagagtaaatacttttcaatgagagggtgacaccatcaaaattttattaaagtaaattctttaagtacagaatggattgctggaggaaaacttgagagaaataggaggctaggaccataatccagatataaagtgttcaagatctaaggtacaactgtgtacgggggaaatgaaaacaagtcaatgaatgacaaaaattctaagatggatcaaaaatgacttcattcaattttcaaatcatttactccacagtctttggaaatgcctatatacaaagttatgtgctacagccttaggatataaagattaataaactgacaataaaacaaaggaggaagaggacgaaagaggacactgattgttctgcagccatggtaacaagtagacaccaacaaaagtttcaatctaccctatttattcatttaacaattagttcctccatgattcttatcatgcttcccccagccaaccagcagcaaacactcccttctgaaactttgccagagtggattcacttcaatgaagataattctcaaactaattaacaatggtctcacctgagttaccacgcttctaaagctatcatcatcctattcccaatctgaaatgttcttagattgctggacttctgactccccccgcaaaacctaagaatacgctcctttcagagactgtggttgaccaggagcattccctcttatttaagatgttatgaagcccaaatccaatgtttagtaaaactgtaaagtttgttgaaccttaataccattactatgttgcatttttttgtcatttttgtcatatttttgctgtttctatcattaacacaaaaacaaacctagttgtaggagaccatttgtatactattaacaggaagccagaagaatttacttagaaggaaaaagcatttatcacttattccatatgtgctaagtgattgtcatgtgctatagaatatacttagactatgttagattatgagtatatagcagatgagccaccccataattataaacattactttttatgggaaatcaaaataaatgttatggacttcggggtaatcctcatttatgatgactgcactaaggccaattcctggcactctgtgatcacctaagtatttgttaagaaactcaatacagaggacagttaaagtcatagaaattgatgagaattatgtaagacagtgactaaaggcaatggtatgataatgagtactataaagtatttgaggagtatgaaaatgatgggatgtaatttatacttcttattacacgacattaagattttatgaaatgagagcagtggctgaatccccaaagtaagaacttaacaattacatgaacgtaattttacaccaagactctactacataaaatgctcacggacaccagattttaataattgcttatccaatctttgaagccgtctcagaatgaaaatagtgagaactcacaatactgctagagattttactttatgaacaataacaccgtttctgatgagtgtttcatatttgaggatactatggaacaaataaatcatttagcgaaatttgatcatttttcgaataaagaagttgaacctcatggcggtctgaaggcaaattcaaaggctagtcaaaatcagattagaaaccagtcattgcactacactgccatggtaccttaacctcattctctcagatactatctcagtgtatttgaagaccaagtatcgcacaaagtttgctttcaacatgccctcaccccaagaaagtcaatgtgagtaagtaagatgaaagcagtgccttcaacaaaactaatcttgggcagtcaacctcagggaagtccgattagccagtcgctgggtgtaaccttcaaacaccgctgggaaatctaaagaagaggctctactgtctaaatttcaggccaagtttctgccaagggacaggcaggaatggaaatacagaattataatgcatagcatgtgtaattgaaaacaagcaagatttcaaagatagcaggtataaatgtgcactcacaaagctttagttggtcagtcttttaagagttttattaaacaacaaaaactgtgagaggatgtcatttagaaaccatgatgagcatcaacctccccacagggtttgtattaggaaacaaaaataaataaattcactgagaagaaaaggaatagagaaactggaaagaaggcacttctggtcataaactagccatagccagaatgctcaaaatatgaaaacagaaaggcctatatgttggcacaaccaaaacctatggttgtaaacaataacctaattcattgatgtgatattctaaaaggacaaagtgctggaagtaaagtggattattttttgaggcttgcatacgaagagatttatgttataatatcatctgatatctaaatgctggagtttctaagttgtagaccatatcatggcaatggactaattcattaaagcatgatattgttatttttaatattttgtatttggcattcagcactgactgcattgtacatacatgtattctctacttacaagtcactatatacaatagatatacaacattttaattaaaatttgcacaactcctcccatgttaaattttttaacattctgcaagatatgttctgccttagctaaattaagtactccttaattaatccatttttagcacttcattcactgatacaagcagttgcttttaccatttagtaacaatgcttctcattaaaggacggtaaaatgtcataatggaaataatttgcgttgatgaagatgattgaatttcatcataaaattaataacgataaaaagtaatggcctatatttatccaggagaaacacaaaacaattttatcttttgcactttccattacgcttttcaacatgcttatggtgtaactagcagaaaactatcaccatcatcttgttacaagtagaaaacagtggctcaggctgggcgctttagctcatgcctgtaatcccagcacttcgggaggacgaggcaggtgcatcgcctgaggttaggaatttgacaccagcctggccaacacggtgaaaagccgtctcaactaaaaatataaaaatttctccacatcctctccggcacctgttgtttcctgactttttaatgatcgccattctaactggtgtgagatggtatctcattgtggttttgatttgcatttctctgatggccagtgatgatgagcattttttcatgtgttttttggctgaataaatgtctcagggatctagaactagaaataccatttgagccagccatcccattactgggtatatacccaaaggactataaatcatgctgctataaagacacatgcacacgtatgtttactgcagcactattcacaatagcaaagacttggaaccaacccaaatgtccaacaatgatagactggattaagaaaatgtggcatatatgcaccatggaatactatgcagtcataaaaaaggatgagttcatgtcctttgtagggacatggatgaagctggaaaccatcattctcagcaaactatcacaaggacaaaaaaccaaacactgcatgttctcactcagaggtgggaactgaaaaaagagaacacttggacacaggaaggggaacatcacacaccggggcctgttgtggggtggggggagtggggaggggggagggatagcattaggagatatacctaatgcgaaatgacgagttaatgggtgcagcacaccaacatggcacatgtatacatatgtaacaaacctgcacgttgtgcacatgtaccctaaaacttaaagtataataataaaaaaaaaatgtaaaaattagctgggcatggtgatacacgcctctaatcccaggtgatcccagctattcgggaggctgaggttagagaatcgcttgaaccagggaggaggaggttgcagcaagctgagatcgggccactgcactccaccctgggtgagagagtgagactccatctcaaaaaacaaacaaacaaaaaattaaaaaagaaaaaaacagtggctcaaaatgcataatgcttgcctagagcataacagggaaaaaaggaaaatcagatgcttttagaagactgatacactgaaaactatttgagcgttctgttaatcaataaatcctaaacctaccaatacaaatggaacttatcatgcagccaatccagtaaataatggtagctggaagtaatgatagtgattgtaaaaactatggctgggcatggtggctcatgcctgtaatccgagcactttgggaggctgaggtgggcggatcacctgaggtcaggagttcagagaccagcctggccaagatggtgaaaccccgtctctattaaaaatacaaaaatcagccgggtatggtggtgcatgcctgtaatcccacctactcgggaggctgaggcaggagaattgcttgaacccgggaggcagagatgacggtgagccgagatcacgccactgtactccagcctgggaaacagagcaagactccgtctcggagggggtaaaaaaaaatctatattgaaaatatgagacacagaaaaatatactccacaaacgtttattgagttactttgtgccaggctatattttagactttaataatacaatggtaaataaatgatcccagagatatgttctcatgaaagaatgactgtaatgggaaaggaagttacgaataaataatttcaaaattctcagtttaccacttgccactgtatccctgcttcattgaattgccttccataaaagccctcttcgctgggatagtttttggaaattaaatcagaatggaagctctgcagtgttaataccaaacatcctgagagtgcctcagagcaaatgcacagaagctggtggggaaaagtcagttaaatgaaaattcgcaaccaactgtgactttaggagttttaaataagacgtgtttcagttgaaaagtttttcaaaaatcaaatttctgccgtgtgccctaatcaacaggaaaagttctatctttaaattttcaatttccaaatgcaggaaattttcaaaattgtctcttccgtcacaattgtcctaagtttacatatgttaaatatattttatttgaaaaatacatccttgactatttaaatccttagaacaaatatttggtatgtaacttctaaacccaggagaacagacactaacttgacataacaaatggaagctactcagtcagcatgggagactacagatagaaaaacatctgtactttcttacaattctctcgacatgcctgttgtgggaagaactattagggtttacatttgagatgaaagtattttgactcagtgacatttaactctgcttaagtgattgtcacctgcggttttcgtgctttgcttttgacctaaccaaattgactttttctttcctctgctgctagaaaaagtatagtcagtttcagaagtaactccaccccttatcttcctcgctaacataaaatagtctatttgtgaaccttaattgtttacagtgttagaagttatacttgatacacagtgaggccagaataaagatgtttatttcatgtgacataaatttaattggttattattctttctggtatattttgggatttcaaaatatgcctgatggtataagggcagtcctggggcaaattactcaatgatgactagcttaacgcagatattgtacaaaatgatcaggtttttttttttttgaaaaaaatatggtaaaaatggacccactacatataaaagagcttagcctgttgaggcaaaaataccttgatcaaatcctgaccctatcactaataggtaagggactgtggtaaaattcactaatttccctgtcccagtttttatctataaaatgagtcatattagtatcttgcaaataattagggatgatgttaacagagaaaatgaatgcaaagtaaatgctcaatatatacgatctattatttttcctgatttccttccaattggcacataattgtaattcataggtttgcttgcattcatgccttcattaagtatttgtggaatgcctaccatgtgtcagacatgataccaattcaccaagcaattaatcacgttttataattagaatggctccatttcctaattcctaaggaagaaacgagtggaccattggacaaaccagatggcatacaacactgatgtgactctctcagcacaaaacatttatgtgggatggtgtcatggtggtatcatatgtcatacgcaacatcagaataaggggttcagtgttgagcaaaacaccatcacacacaaacttcaacaactgacaaaataactgatggcgaattaagttttcctgaactaatccaaagttttcagtagtactctaactgaaaactgaaaccagtggacgaacatcacgcatttgtgtattttctaagcactactggaggcatgctgatgaaacacacccaatcaagaagtagcaaactttaacccattttcaaattacaaagatacattttccttttgacagtacttatgaaatttcatttgagtttggagtttctggcttccaccattgtaattaggacctcccaactacaaatacaataatatccatggatgtcaagtaatttccaatgtgaaaaaaatgcaatttagaaatttacagaagtgaagataatcaaatgtgaagcattgatggagaaaggtacaagtgaaaaagagagtaagcatccaaaaccatgtaacacaaatatgatgatgataagggataactttataaaagagaatgtaataaatgatgttaagaatgcgtaaaacatagctgagattgattttcattaaaatgtatatactaaagtatattttttgaatagtgaatagaatttgatgtatgtgttaaaagacactgccttccatgcctgtaaagtacagcatgacccaatccttcacacttagctaaaagcactctaatgtcatccctctttctctttcacacattggtcttgttttgtttttgcatctcaaataccgaaggccattttacacctcttgatcttcatatttggtgctcttttacctaaaataatttctctttttgcatttttgattcattctcacccattaggtcttaactcatatggcacctcttcagagatgcatttcctatcccatttaaagaagcccaacccctttccctttattttacattgatttcctttacattgcttgtcacaaactgtcattattatgtttattttttatataagaatataaaaaccacaaaggcaggaacttcctttagattgttttaccaatgactgagaagtagtaggtactcagtatttgttaaatcagtaaatgaatggagagagaaccttttgggaataaaggttcattttcatggtctacaccccctgaatgtagagtaagacacatgttgaaaattgagcactgcttgaaggggcagaaagcacatagcaaggaacaggagcagcctgtatttttctccctacaaaattctgcaaaagagattcagtttggtatagaattagtttttatcaagtatcaattatatacaagaacttttattatgtttttttttcatttaaattcaccactctcttgtgagttaagaatacagcccaaggtcatacaaccaataagtgacagtctgattaaagtggaaaaaaaaaagtagagtccttggtttggctcccagttctttcattttgtgaccttggataaagttaagcataatgcacctcagcttcctattgtattgcaagaagtttttcttattgatcacatttccaaaaataagacttgatttgaagaacatctcatgctctagaaactgtatcagattatttttaagtgatagggaaagaagcattaatttccaaattagagagcattagcaggttaatcaagaagcctatgagtgatgatgacaaagttagtacattttaaattcagattgaaaatactcaagacacaggaaaactaatgttttattcattgttctaaactttggcatacacactacaaaatagcaccgtgctttacaaaaacgtattttcaaaaataatattgactgatatctacagaaaaaaaaatgtactcaagtgctctcagactgaggataggaaaagcagactccttagaactttggaagcatagcttccaaaaattttgtgctaagcgtctgcatacctgggggtttgaaagattcaagtgtgtgaattccttgtcatctcactaaaactatgagtcagcggtgggtaggattctaccaaataatgataattgtaaaaaatgctttttaagctcagatatatgagaaagggattcaataaagaaacaaaaacctaggatggtatacacacatttataaacaatatgatcactaatatataactataatatgcatgcaaacattacatatttggaaagcaactccctttgactagatattagcaacttcaaagactaaatagagaaaaggaaaggctttgcgtagaatcttactgctattttaattactgaatgttccttttgtccatttgcaattttaaaatttcttctttccttttctcagtggctggatgagggttaaaactgatatgctaaataccacataacccattttcttggtatagcttccagttcttcttgactctgaaatgtcggcctctctcaaatacctctccctcaggtagagctctactagcaggggcctgtctttcctgatgaccagaaacccaggggcttggtataactatctcaattactatatcctatggagcctgactccttatcatagctccagtccccatatgggctctgatcttggattgaccagatgggtcatttccactcttatctcaatgggaacgtgccccttgattaggaaagctttccctcagagaaaacacatcccattgacggttttggccccaagagttcaaccgttagttgtctttgatattttaatttcataagtctggatttaatctctcacttttaaacattttattacaaaagccatacatgcttattgtagtggaaaactaaaacagtacagacgcatttaaagttaatagtgaaagtaccccatatctctacagcaccacagtcccattagctagaagtaatacttgtcaccagatgctatgtcatccatacatccatgcatctatccattcagccattcttttagctatccatttatcatactcatctgcctgtctaatgagattaaacatatacactgtctatgcatgtactttcttaagatgtgctcaattagtaaagattcaaaatttagctttaccactcactggtattatgaatttggataagaaacttaatttcttcatttcttcataccctcattggtaaaatgaggcaaagacttttccaagaaggtaagtgcaagtaaggcatttagagcaatgcctggcataaagtatgttttcagcaaatttcaagtttaaaatgtatatacacatgtatatatacaatgtgaacttcaaaattaatttcagtaatgcatgtattcatttatccatttatttattctgtaactatttattggacacttgccataagtcgaggattatgctggacactgcagctgaaatagtgagcaaaaataaaaacaaacacaaacaaacctagaccctgattttatggtgcctatagtccaatggtagagatatatctgcctaacagtccatagcatgaaaaatactggagctactgtgtacaacgctgcaatgaacatccttacacatttgtcgtagatatgtatgagtattactatatatctaattcttaaatgtgaaacctcaggatcaaatatatgtaaaattacatattttgaaagataatactaaattgtctgattaaaatattacaagttgtgtttcctccaaaagaaacacagggcctatttacatgaaccctcataataagaagatatttgtactatgcatttatttattagttaagcttaattttattttgatgggctatttctaattttcccaagtgaatgtcctgaccataatatgtagccacttttaaaatattatactttgtatattcattgtaggagtgttatcatactgaggttattgattttttattactagtgtcattctgcagtccatcataggttttattactgtttaatggtctttcacaatggaaaatattttaattttgtgttggtaaatttgtcggtattttacagcctctaggttttatatcaccttaatattattgtaatattcttctacattgtaataaagtatttaaatgtttattcacattcaatcattatctgaaagttatcttagtatttgttgtgccttgggtttccacagttgaaggctttattagctaacctattctatctctagagacatgaaatgtcaccctaattgtgtactaaatttacctaaataaaagggaatgttgtcaaaatatctattccacaccattaaattatttctctatcatgtcatactatgttaagtatgttataaaatctactaaagcaaatcacctgtttgaaaataatttcttaactgtactcacgcatttacatttaaacaaattttagaattatctagaaaactgaatccctcttaccattcatgtgatttatgttcagtgtgctcaccctgaacataaacaccctttcttctctgcttattctctaagtggctgaccctttcacactgtatctcctgtgatcattagctggctagattccagttgcattaagctggtgggaagtaccagctggagattgaaagaagagggaaagagaaagctggggaaatttctctattatttccctgctccagagctgcataatgtagtatctgagttctaccaacaactacattccctccattggtgcagctttcactgaactccgttccccctttcctttcagctactatatagtaggaatagtagaaatagtaactacttcctactattgctcctctctagattatttcttgtcacctatttgttaatatatacttctgtaacttttaaaatacaattatcttcattttaccatctgagataaattctatttattgctagggttctgttatatcctctaaaataatacaaatatagatacacagagagtcgcatacatacatgtttgtgggcatgtgagtgtgtaattatacagatgctcctcgacttatgacagggttacattccaataaacccattgtccatagaaaatatagtgagtcaaaattgcatttaatacactgaacctgtcaaatattatagcttagcctagccttccttaaacatgcaagaacacttacattagcctatactttggcaaaaccatctaacacaaagcctgttctataaaaactaaagtactgaatatatcgtgtaatgcattgagcacagtagtgacagtgaaaaatggcatgattaaatgggtactcaaagtacggtttctactgaacgcacactgctttcacaccatcataaagttgaaaaatcattagtcaaaccatcttaagtcagggaccatctagatcttgattgaagtaacttcaggaactttagatttaaggggtacaagtgcaattttgttacatggatatgttgtgtagtgatcaagtctcggcttttagtgtacccatcacacaaatagtctacaatgtacctaataggtaatttttcatctctcacccccttcccactctcccatcttttggagtctccaatgttgagtattcaattctgtatgtccatgtgtacccattgattagttaccacttataggaaaatacagtatttgattttctgtttctgacttatttcacttaggatgatagcctccagtttcatccatgttgctgcaaaagacataattttattcctttgtggctcgttagtattccattatatatacacaccacattatctttatctactcatggacacaacttgattccacgattttgctattacgcatagtgctccagtgaacatgcgagtgtgactgaagttactttcaatgtacaaactaacttagggagaactagcattttcatcatatgtgacttcctttcctcatgtctttatttatgtacttatatacaactttaaacttcctataaaaaaaagcttatactttcttgtgcggtttacttctaagaaaactacatagattttggaacttctcttttttaaaaataattttattgtgtgttttaaggtatacacatgatgctataagatacacatgtaaatggttaccataatgaaaccataatgaaagaaattaacatatccatcatctcacataatcgttcccccaccctctgaccacgagaagctataatctactcatttagtaaaaattctgaatacaacacactattaactataatcctcatgttttatattagatctttcaacttgtttatcccacatatttgctactttatagactttgacctacatctccccatttcctccttccacccccaacctggtaaccactgttttattctctctatatagttatacacaatggaatattacttggcctttaaaaaggagatcttgggccaggcgtggtggctcatgcctgtaatcccagcactttgggaggccaaggcaggaggatcacaaggtcaagagattgagaccatcctggccaacatggtaaaagccaatcactactaaaaattcaaaaattagtttggcttggtggtgtgcgcctgtaatcccagctattcaggaggctgaggcaggagaatctcttaaagccaggaagtggaggttgcagtgagccgagattgtgccactgcacatcagcctggtgacagagattccatcaaaaaaaaaaaaaaaaaaaaaaaaaaggagatcttgaccaggtgtggtggcttatgcctataatcctagcacttagggacttagggaggccatggcaggcagatacgcagatcacctgaggtcaggagtttgagaccctggccaacatggtgaaaccccatctctactaaaaatgcaaaaattagctgggtgtggtggtgggcgcctgtaaatcccagctacttgggaggctgaggtaggataatcacttgaaccggggaggtggaggttgcagtgagccactgcactccagcttgagtggcagagtgagacttcatctcaaaacagaaacacaaaaaaaggagatcttcttatttgccacaggacagatggagccgaagaacattaggctaagtgaaataagcaagacacagaaagaaaaatattgcatgatctcacttgtttgtggaaactgaaaaacaaaaagtaactatgctgagtatcattttattaccactgtacatttcctaattttgagatcattttacataatgagaaaatcatattattttcaaataatttatcttgtgctttccaatatatatttcatgtaactttctctcgtcatataatattggctaggttctccagaaaaatactgaacagcgtcaatacagaggaggaatattcttgtcgtatttattgtttgagtcattctagcatattgatatgatttggatttgtttccttgcccaaatctcatgttgagttgtgttccccagtgttggaggaggggcctggtgggagatgataggatcatgagggtgaatttcccagttgctgttctcatgataatgagttctcatgagatctggttgtttaaaagtgtgtagtactgccccctgctttctcctccttctctggccatgtaaggtataagatgtgcctgcttccccttcgccttccacaagaaggtggaaatttcctgaggtatccccagccatacttcctgtacagcctgaagaactttgagttaagtaaacctcttatctttacaaattactcaatctcaggtagtttatagcaatgcgagaaaggactaatacagaaaattggtaccgagaggtagggcactgctacgaagatacatgagaacgtggaactaactttggaacagagtaagaagcacacgttggaacagtgtggagcgctcagaagacaggaagatgagggaaagtttgtaacttcctagagacttgaactgcttggaccaaaatgctgatattgatatggacaatgagatccaggctgaggtggtctcagatgaagatgaggaacttattgggaactgcaataaaggtcactctcgcaatgctttaacaaaaagagattggcagcattgtgcccctgctctaggtatgtgtggaacttttaacttgagactgatgatttagggtatatggtagaagaaatttctaaccagcaaaacatttaagatgtgacctggcttcttctaacagtatacggtcatatgtatgagcaaagagattatctgaaactggaacttatatttaaaagggaagcagagcataaaagtttagaaaatttgcagcctgaccatgtggtagaaaacaaaagcctattttctcggggtggtgggggaaattcaagctgtctgcggaaatttgcataagtaaaaaggaactgaatgttaataaccaagacaaaggggaaaatgcccaaaggcatttcagaaccctttgcagcagcccctcctatcacaggtctggaggtctaggaaggaaaaatgatttcggaggccaggcctagggcctcactgctctgcacaacctcaagacactgctccctatgtcccagacactccagctccagctgttactaaaaaggccccagatgtgtcttggggtgttgcttcagagggtgcaagccataagcattggtggcttccatgtggtgttaatcctgcaagtgtgcagagtgtgagagttgaggcttgagagcatccacctagatttcagagaatgtgtggaaacacctgcatgtccaggtagaagtctgctgcagcgggggagcctgcatagagaacctctactagggcagtgcagaagggtaatgtggggttagagctctcacacagagtccccactggggcactgcctacttgagctttgagaagagggccactgtcctccagagcctagaatggtctctccagtgacagtttgcaccatacacctggaaaagccccagtcactcaatgccagcccatgaaaacaactaagggtgctgtacaccctgctgagccacagggatggagatgcccaaggccttgggagcctgtcccttgcatcactgtggcttggatgagatgtggagtcaaaggaaattattttggagctttaagatttaatgactaccctgctgggttttggacttgcacagggcctgtaacccctttcttctgatcgatttaactcttttgagctaatgcctgtaccctcattgtatcttggaagtaactcattttgattttacaggatcataggttgaagggacttgccttagtctcagatgagactttggactgtggacttttgaactaatactggaatgagttaagactttggggaactgttgggaaagcatgattgtattttgaaatgtgagaacaatatgagatttgggaggggttggggcagaacgatatagtttggcactgtgtccctgcccaaatctcatgttgtattgtgatccccaatattgaatgaggcgcctggtgggaggtgactgaatcataggggcagatttccctcttactgttccaatgatagtgagttctcatgatatctggttgtgtgaaagcgtgtagcatctctgcctgctctctcttcctccttctctggccatgtaagccgtgcctacttccccttcaccttccacagtgatttcctgagacctccccagccatgcttcccatacagcctgtggaactgcaagtcaattaagcctcttttctttataaattacccagtcacaggtagttgtttatagcaatgtgagaacggactaatacacatatcaagataaggacatttattcccagattagtaagaacctttctcaggacttggtaatgtatttaagcaaatgtcattggatatattacttttgcttttactgataggactgactagttctggcttcctgactttaagaaaaggaagaacaaagattaaatattacctgttcactgttttgcattttattattaatataaatatgtcacataaaaacatcaattaaatgaaagccctgaatttcatcactttaaaagactttccttattgctctttaaaatatatggcaaatgtggatggaagtacacacttagcaaataattttgtcagctaaaactttttattccaatgttgactcaagtgtaaatagttaataaccttccatatttaaaatgctccattaggtaaataatctgtaattggtgcctctttatatcggggaagaggctatattcttggtagcaaaatagtctgattcaattacctacatatatagttactcaactagagaaggtaggcaaataggtgattcacaaacactaaacataactggacatagttggaaatactatgaatcacccatgcatcctctatcatgattatcatagcagtgttcctcaaagtatatctcaacttatcagccattgcatccacataatctgatgaattgaaaataataattaatataagatagactggttggaagcaaatagcttcaaatagaaagtattacaaaggttcagataatcttaatagagctaagcttctagaggtttacatgaaccaaataaaaatcagcactgagctttcatattccttttcaatttctcattatcaatttgtttctctgtgtgagtgtagggtgatgaagaatgaagtagatgaaattttcagtaaagtatacatatgttgccaagaaatcagaggcaaataattctataactttgggtcattgtactaaataaaagagaaaccttagtattgcaaagtttaaactgattatgttaatatgcatttgcctccaaatattatagtaaaataatggaataacaaaatttaattctggtggaaatattttggatattgtacagatgcacatgatgctttgagcatattaaatgtagacttacttttgtgttcttatttaagttattttcactgcttggaatgcctgatactttttttttcatttatttagctgaataaatgtacatttactgttatcagtcagtcaatatccaaatgcttggtgtgcagttatttcccagaatacctcaagagcttggtacacaatgcccttttccaacctctgaacgtttatcaccagatagactctatcatataatacgttgttatcccagcttgcatgtgcacacgtgcacacacatactatatgacctgacccattagaattcattcattcatatatatatatatatatacacacacacacgttttaatattaaagtaaattaaatatattaagtaaataaaatacacaagatacttacaagtaaagcaaacaagacaacattactagcatttctttgactgtttctatctgacagagccactcaacactcgtaacacctattatacgagtcaaatcataccttacaaaagagtttttgtctaccacaattctttattgttgttaccttttctaatttttttcagaatgggaggggaaacaatatgaactcctagaagacaatgcattttaacggtctaataccaagactggctcattttgcacccattaaatgcctgtgaaaaaattgaccaaaattggtcacagatggaacacatctcattgctcttcttagataatttctattacttacattttcttttacaatcgtttttttacttagctcacatccaaatgagcaaattacattcatttggaaatgttattcgattcacattgtttgcccccatggggatttttttaacgcctttttagaaactacttaaataggtcctaaatttattatcttggtccatgggtgttgaataagcaaactgagaaaatcattgttacaactgtcaattctacattaaaaatgatgttaaaatctggtcatacatctctggatctgacatattttagataaatattagaaagggttaagtagctgaggcgatagacattttaactagctagatcaaatctttctcataatgtatgcatagatcaaaacactacattttaccccattattatctgcttttatatttttttaaaaaagggttagctgtatatcgaaactctaaatttatttatcccacataactgcaagtttccatgtacacattgacttatttcctcaccctcactactcctggtaatcaccattctactgtctatgtattcaacttatacattttcttcagatttcagatgttagataacgtagcatatttttttctgtgtcttgcttatttcacttagtgtaatttccttcaggctcacctatgttgttacaaatggcactatcttttgtgaggctgaatatttgtgtgtgtgtgtgtgtgtgtcacaatttctttatctgtcagtggacactcaggttattttcatatcttggctattatgaatcataacgcaatgaacatgagagtaaggctatctccacaaggttctgatttcattttctgtgggtctatacccaggagtgggattgttgggtcatatggtagttctatttttaactttttgaggaaacactcccagacaattttccataatgtctgctctaatttacaccgacaccagcagtatgtcagggttccctttcctccttgcctttactggcacttgttatctcatcttttagataatactcatcctaacaggtatgaagtaataccttattatgattttgatttgcatttccctaatagtgatattgagcacgttttaatttccctgttggccgtttgcacatcttctttgaaaaaaaaaatgttcaagttctttcccaattttttaattgggttatttagtttgtcactatggaattgtgcaagttccttatatattttggatattaaacccttatcagatatatgttttgcaaatatctactcataatctgtaggctgtgtttttcttttgctttccagaagctttttagattaatgtagttccactagtttatttttgttttcttgcctgaaattttgatgtgatattcaaaaaatccttgcaaaggcgactgtcagagagctttttcctctctgttttcttctaggagtcttatgattttaggtcttatatttaagtctttagtccattttcacttaatttttgtgtacagtataagacaagggtacaatttacaacaccatttattgaagagactgtcctttccccacatatcttcttggtggtcctgtccaaaattagttgattatataggcttaggtttatttgtgagatctctattctgttccatcagtttatgtgtctgtttttatggcattacaatactctttttaatactgtagatttatgatataatttcaaatccaaagagcagtatttccaacttttttttcctcaagattgttctggctatttgggatttcatgtaagttttataatgctcttttatttctgtgaaaaaaaatgccatttagattttcacagggattacattaaatttgtacagtcaaccttctatttccacggatgcaactgtagaccagaaataatcaaaaatagaacaaaaaactcaatacaacaacaaaaaatattaatacaagtaaaaataatatatggtaacaactatttctatagcatttacattgtattaggtgtaataacaaataatcgatagatgttttaaagtatataggggggtgtgcataggtatatgcaaatactatgccattttgtataagggatttaagcatctttggattttggtatccactggcatcctggaacccatgtcccgtggataccaagggacagctatatatccatttgggtagtatggaaattttaacaatattacttcttccagtctacaaacatgggatattttcccatatatttaccttttaatttgttcctcaatgttttatagttttggttgtacgtatttttcactttcttctttaaattgggtcttaaatattttattctatgttatcataaatagaattttttaaaattttttggatatcttttgcataaaaatgcaactaattttatgttgattttgtattccactacttactgaactcatttattagttctaacatttttcttgtggagtccttaggggtttctacatatacgatcataccatttgcaaacagaaataatattacttcttcctttcagatgtgaaagccttttattaattttgtctcactgctcctgctagtatttttggtactatgacaaatggaagtggtaagagtgggcatccttgctttttagcaaatcttaaggggaaagctttcagtacaaccaccccacaaccaccgttgatcatattagctataggcttttcataaatagccttgatgttgaggaaatttccttccatacatattttgcgaagagttataataataaaaggatgtttagctttatcaaatgctttttctgcatgtattgagataatcatgtggtttttcatctttctgttaatgtagtatgtcgcattgattgatttgtgtatgttaaaccaaccttgtgtcctagggctaaacccacctggtcacggtttataatccaatgtgttatttgtcttgctaatactttattgaggactttcacatctatattcctcctagatattggcatatatatattttcttctcttgcggtgtctgtttgactttcgtatttagggtgatgctgaagtcataaatggctttggaggtatttcctcttctattatttagaagattttaagaacaaatggtataaattactctttaaatgtttggaagaaatgaggagaagtaggtcaaaggacacaaacttgaagttatattggataaataaatctcgataactgcttagtatgatgactacagttaatggcattgtattgtacactgaacattagctaagaaaagagactttaggtattcttaccataccaaaacagttattatggaagataatggataggataatttggttgaattcagtaatcatttcattatgtctatgtatatcgtaacatcttgtaccccttaaatcaggggtatgtaatcttttggcttccttaggctccatttgaagaataattatcttaggccacacctaaaatacactaacactaacaatagctaatcaactaaaaaaaaaaacctgcaaaaaaatctcataatgttttaagaaagtgggtgaattacagttaggctgcattcaaagctgtcctgggccacatgtagcccatgggctgtgagttggacaaggttgccttaagtacatccagtaaaagaataaaaactaaaactaaaataattagcacatattgttgtatttcaaatgatgacaattagattcgacagttgacaagtcaaatataatacatttaaatggtgcaattctacttcttgaggaaatcctttcaaaaaattggtccaactggaatgtataaatatacaattaagaattgtgcatttaaaatcaaaagtaataataaactctaaattaaatcagacttttttgctgaaactaaacgaggtgaataaaataggtgaagtgaacctaatttataaggctgttatggctcaaattcttcaaataaatttctgttcagttcttatcattttcataaagttgatttatgaggaactatgcaaatctagagtagtctactaaagtctgctttttatatgcttatttcacacaaaatggttattgaccatatgtattttgtctaggcccttaccaagaggagctgttaacataattgatttacaattcagttaggaagaaaacatgttaaagctaattttactctgaaacaataaatcaacccaatgtgaagtatatcacagcccataaaatgaacagtgatccaattgtacagttgaaccatgtagctcacatatcccatggcacttaaaatcttcatccagtcattaaataagtctcaagatccaaaagatttacataagcacaactgaataactttattagctcttctcttctgggtttataatgatgaactaaaaatactaacctgttataaattacatcagtaatctttcagctctttttctcatcatattataaatttacaatgttactgagattaaaaaatgtttatcatatgttaattatttgcatgatctttagcatttttaaacaatggaaaaaagagagctaccaaaaccagagttgtgttcttggcatcagaaagctctagtaaacatcaaataaactttaacagcttagtgcgtaaataacacagcctcaagtacaacaccttagccacagatagtacttaataaatagtcattgtttggttgtatctgtgtaacacaacagaagaaagtatacaatcctaatccttgctttagaatctagacattgttttcttagccatttctgcaataacagttaaaataaacgtaccagcatttctggtaaagactctaatatataagggtgttccagaaatttcaatatactagatttgacagtatggcttgagagagggatcccactgctgagcattctctgcctctcatatcatggatcatagtcacttatgaaattttatctataatattgtagtccataggtatatatatgtatatgcatgcatgtgtttatatacatgctatgattctacaaaatacttgacatctttaatgaccgcctataaagatacacatgggctgaaaatggatgaaaaaagatattccatgccaatggaaaccaaaaaacagcaggagtggctgtacttttttcagacagaacagatttcaagacaaaaacaaagagtcaaaaaaggtcattatataatgagaaaggggtcaattcagcaaaaggatacaacaattgcaaatatttaggcacccaacactggagcacccagataaataaagcaaatattattagagctaaagagagagagagatctcaactcaaaggctgagtagggtactagggggtggaggtaagctggggttggttaatgggtacaaaaattccttagaaagaataaaacatagtatttgcgagcacagcaaggtgactatactcaataatttaactgtacattttataataactcagtatcattggattgtttataacacaaaggataaatgcttgagtggatggataccccattctccatgtgattattatttactgcatgcctttatcaaagtatctcatgtactgtctctctctttctatacatatatacacatacaaactatgtacccacaaaaatttaaaaaattcccctggaatatatgcaatttctaataggtatatctcttaatctaaataatgttttgaacattctcatatacttttatccaatatatatgttacaaatttattacagctgaagaatctacgcaatcttaactttctatggaggcaatgacactactataaactatttatgacactgcggggttagcaaatcaacccatgaacaaatgtcattttctcttttgatcatattattagttcgatagataaggtcatattcacaatgtagcttatcaatgtctcccataataaattcacagacaaaattttgaatctgtactaaaatatagtattttaaaaacacacatgtggcagcacaccctatccaaaaagtgatggcaaatggccttgtgtcagtttaaagttatatctacttgatggtcatgtgactctcatttggactgcttccaccaaatataccttgccaatgatcttggatcttaaggcataaaaatacagctattataataaaatattttactctcctggaaagggtagcttttactctttgtaataaaattcagctatggatgtcttagctataataatatcgaaaccagtaagataaaatttaacagatcacctttaagtctgaaattaatattggaaagagcagttataaggactgcatgggtttataaattatttgtgggaagttttttttattatttatgactgacatgataattatacatatttatggggtccaacacaatgtttctacacacagacattggatgtgctaattaccctgaattaattatcacatattcaaagaaattataaatatataagatgatggattcagatattatttgagaatcaaggcaattcaaattctaggcctaacgtttactagatgtaggagctatgactaccatgacgataaaggacaccaaaagtgagcccaataataaaggctgtgggtattcatcttggagatggtagattcataaagaccttttcaaatggttaaaggcagtcatggttcctctaggttgaagtaaaatcaatgtgtgaatgttacaaagatactgatgcttctttaatgtgacaaattttaggcatgatatcatctttaataattataatagactagcaaaaaaaagatctgcttcagaaacacttccaactggtacaaaaattcagttagtgaatgcatagatatctctaatctgcactagagaaggtaatctgcccagattggcttagattacacattgtgtcttatgttcgcacacattatctcatttgctcctcaaaaaatactaaagtaggtggaacaagaactatatagagatgaattcattgagacttgtataaaaatggtttcacgagaccattgagtttataacagagcagaactctaaattctgattaatgttcaagcaactgactagaccaccttctaaattcatttactagagtcctgcttacacctctataatcaccttaattaatttttctatatcaggcctctgcttgcattgatattattggtcccttcagtgaataataaaatacttgacgttcctatgctgaatttttagaaccaatatttccttaggaaaatatccggaaacatgactttcctaatttaggatacatgttactgcgtcataacaacaaatgtgttaaaagtatttgttgatgattttctcttaaatataaaggtttctatgatgtatatatacacacatatacatgtatatacatacacatacacacatatacatattagcctttaaaatatattccaattcacttttatttaccaaattagactgctgtaaaacatgattactagaaaatgtaccacacaaaactctgatcactctgatcatacttttgtttttaatttaactttttttgtaatttaatctccatagtttataaagggcattactgcttgtcaggaaaaaatgagcttgtatttctcagctgtgtgtaaattacatgcattttatattttttaggcaaggcctctatcaatcaatattttcagaaaatgacactcctcagttaggcagggattgttactgaagctgataaatgtttactcttcattggagactgacaaatagcatatgacatagactactcttatgctcttacactgcttgtactaaaacttgtctagaaatataaaattcaaaaatgtgattttcatgtaaaactgctttcaaatttcttgttaggaagcttgccagacactccagagtaacattttgtgaagcaagtcagtattacacgcataagtaaatgaagtagagatttaaacaaaaatacaacccaatgttgtaatacaggcaaaatataatatttttaaatgatcaccatgtgaggtctatattcaaatgtcttttcataaatggagtccaggcactctttgtagtttatcaagagcaggtttaacagcagtagtttccacaaagcaggctgaagtcatttaatccatggctgctttttatacgcagctgctttatttgagcttagagaggagtagaccacataaatgtcatgttaatattctaaagtgagttaaattgtgttagcaacaaagcttgtcttatcagacatttcaccttggcctatgagaaaatgtgatagttatggtattaattgatattaatcagtaaggcagatatctttgggaatataatgcatagaaaatagtattttcttcctcttcttcttcctgtatttttttgaatctcttggcttcagtgagaacttcctgttggatttattcttatctttccttaattgtttaattttcttctttccacagttcttaaactgaagaaggcctgacgttggccatagccacttaaacactgttagtctttccatcttgccatgccaaactgaaatacttttacctatccactcatttagtaaatatttactcagtgtctaccattttccaactaccacaaaaggtgctagggcgcaattatgaacaaagaagtcagcagatacttttttcacagagcttacagtacagcaaacgggcaacacgtgtaagcaagtaagttcaatacaggttgaacatccctaataggaaaatttgaaatctgaaatgctacaaaatctgtaattttttgagtaactacacgatcatttttaagggaaatccttattgaatcatttcggatttcagattttcagattatggatgctcaactcgtatgtataataaagatattccaaactgaaaatatccaaaatccaaaacacttctggtcccaagcattttggataagggatactcaacatatattttggggcaagttttattatagggaaagctaacattgcccaatatttagtcttgaggcacaaagtcaaccattaatgtagcacttcagctttggaaacatttcatgttaatgaatattttggctgatttttctatgtatgtatcttctgcctcttttcaaacactgattcatggtagcttggcaagctgaatgattctccaagaggagtattatatgcttcaatgtcttatcttaaccacccccccaatctatctttaacatttccacatttcatatatcatctcagcagatttctacccttgtaagtttttgttaaaaagaaatatgccaaatttaatagagtatcatagatgaagaagtgtatatttgtatacttatgtctcttaaggagctttttatactaagaaattcagaaaactacatgttctggttctttaataattaaatatgtgtgttattcttttgactttcctatcaaagtaaaaacgttgtctcagcagggcattcaacatatcttaaccattcaccatagtactgactatgtaataaacaattttctaaatgtactagcaaaactaaagcatatatagtagcacagcctctgctctatatgaccatggtccaggaggtatacttaagagttggttaaatatttatagctgagttagtcatgtttttggctttgggaaactgcagtgttcagatccccactgttaaaatgtaacgtgggccaggcacaatggttcacattcctaatctcagcattttcggaggctgaggcaggaggatcgcttgaggccaggagtttgagaccaaccggggcaatgaagcaagaccctgtctctacaaaataacaataaaaaattgtttaaatgtacctctgcattgtgttgtacacctgcaattctagttactcaggaggctgagctagaaggatcacttgactcaggagttggaggcctgtggtaagctacgactgtgctagtgcactccagcctgggcaaaagagtaatatcttgtctcttaaaataaataaaatgtaatggtgccataagtaaatgcatagatatgtgatccaatccatgagttttaaaatatgtcaggtaacaccaaagtaggacacaaaaacaatttgaatgtttatgaaaaagagtacttcaacaggaagtagacttagagagccataggacagaagagtgtcttcctaggcaataggaatgacgttgaatcacattttggaaatagtaagatgtttgccctaggaataagcttaaagtagtaagagataagactaaaagaaaggacaggactagaaagcctatgaaaaatattagtaactactgagtttggaatctttaatataggtagtgggagccactaaatattttgaataatgaagttacatgatgaaattagtattttattaagagtgtggaggctatgtattcaatagattcaaatatgaaagagatgggagatacagaaaattttcagccatgagcagaaaaagagtaggaatagagcctaccagtgggaaaattaaaacttgaaatattggatcagaaatctgatttgagaggaggagccaagatggccgaataggaacagctccggtctacagctcccagagtgagcgacgcagaagacgggtgatttctgcatttccatctgaggtaccaggttcatctcactagggagtgccagacagtgggcgcagctcagtgggtgcgtgcaccgtgcgcgacccgaagcagggtgaggcattgcctcactcgggaagtgcaaggggtcagggagttccctttcctagtcaaagaaaggggtgacggacagcacctggaaaatcgggtcacacccacccgaatactgcgtgtttccgacgggcttaaaaaacggcacaccaggagattatatcctgcatctggctcggagggtcctaccccaacggaatctcgctgattgctagcacagcagtctgagatcaaactgcaaggtggcagcaaggctgggggaggggcacccgccattgcctaggcttgattaggtaaacaaagcagctgggaagcttgaactgggtggagcccaccacaactcaaggaggcctgcctgcctctgtaggctccacctctgagggcagggcacagacaaacaaaaagacagcagtaacctctgcagatttaaatatccctgtctgacagctttgaagagagcagtggttctcccagtacgcagctggagatctgagaaggggcagactgcctcctcaagtgggtgcctgacccctgacccccgagcaccctaactgggaggcactccccaaaaggggcatactgacacctcacacggcagggtactccaacagacctgcagctgagggtcctgtctgttagaaggaaaactaacaaacagaaaggacatccacacaaaaaacccatctggacgtcaccatcatcaaagtccaaaagtagataaaaccacaaagatggggaagaaacagagcagaaaaactggaaactctaaaaagcagagcacctctcctcctccaaaggaacacagttcctcactagcaacggaacaaagctggagagaggatgactttgacgagctgagagaagaaggcttcagacgatcaaattactctgagctacgggaggacattcaaaccaaaggcaaagaagttgaaaactttgaaaaacatttagaagaatgtataagtagaataaccattacagagaagtgcttaaaggagctgatggagctgaaaaccaaggctagagaagtacgtgaagaatgcagaagcctcaggagccgatgcgatcaactggaagaaagggtatcagtgatggaagatgaaattaatgaaatgaaccgagaagggaagtttagaggaaaaagaataaaaagaaatgagcaaagcctccaagaaatatgggactatgtgaaaagaccaaatctacgtctgattggtgtacctgaaagtgatggggagaatggaaccaatttggaaaacactctgcaggatattatccaggagaacttccccaatctagcaaggcaggccaacattcagattcaggaaatacagagaatgccacaaagatactcctcgagaagagcaactccaagacacataattgtcagattcaccaaagttgaaatgaaggaaaaagtgttaagggcagccagagagaaaggtcgggttaccctcaaagggaagcccatcacactaacagcggatctctcggcagacaccctacaagccagaagagagtgggggccaatattcaacattcttaaagaaaagaattttcaacccagaatttcacatccaggcaaactaagcttcataagtaaaggagaaataaaatactctacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccattgagactaggaagaaactgcatcaactaacgagcaaaatcaccagctaacatcataatgacaggatcaaattcacacataacaatattaaccttaaatgtaaatgggctaaatgctccaactaaaagacacagactggcaacttggataaagagtcaagacccatcagtgagctgtattcaggaaacccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaaggaatcaattcaacaggaagagctaactatcctaaatatatatgcacccaacaaaggagcacccagattcataaagcaagtcctgagtgacctacaaagagacttagactcccacacattaataatgggagactttaacaccccactgtcaacattagacagatcaacgagacagaaagccaacaaggatacccaggaattgaactcagctctgcaccaagtggacctaatagacatctacagaactctccaccccaaatcaacagaatatacattcttttcagcaccacaccacacctattccacaactgaccacatacttggaagtaaagctctcctcagcaaatgtagaagaacagaaattataacaaactatctctcagaccacagtgcaatcaaactagaactcagaattaagaatctcactcaaaaccgctcaactacatggaaactgaacaacctcctcctgaatgactacggggtgcataatgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaagacaagaaataactaaaatcagagcagaactgaaggaaatagagacacaaaaaacccttcaaaaaattaatgaatccaggagctggttttttgaaaggatcaacaaaatagatagactgctagcaagactaataaagaaaaaaagagagaagaatcaaatagatgcaataaaaaatgataaaggggatatcaccactgatcccacagaaatacaaactaccatcagagaatactacaaacacctctacgcaaataaactagaaaatctagaagaaatggataaattcctgcacacatacactctcccaagactaaaccaggaagaagttgaatctctgaatagaccaataacaggatctgaaattgtggcaataatcaatagcttaccaaccaaaaagagtccaggaccagatggattcacagccgaattcgaccagaggtacaaggaggaactggtaccattccttctgaaactattccaatcaatagaaaaagagggaatcctccctaactcattttatgaggccagcatcatcctgatacgaaagcctggcagagacacaaccaaaaaagagaattttagaccaatatccttgatgaacactgatgcaaaaatcctcaataaaatactggcaaaacgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctccatagatgcagaaaaggcctttgacaaaattcaacaacccttcatgctaaaaactctcagtaaattaggtattgacgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagagaaagtcaaattgaccctgtttgcagatgacatgattgtatatctagaaaaccccactgtctcagcctaaaatctccttaagctgatagggaacttcagcaaagtctcaggatacaaaatcaatgtacaaaaatcacaagcattcttatacaccaacaacagacaagcagagagccaaatcatgagtgaactcccattcacaattgcttcaaagagaataaaatacctaggaatccaacttacaagggatgtgaaggacctcttcgaggagaactacaaaccactgctcaatgaaataaaagaggatacaaacaaatggaagaacattccatgctcatgggtaggaagaatcaatatcgtgaaaatggccatactgcccaaggtaatttacagattcaatgtcatccccatcaagctaccaatgcctttcttcacagaattggaaaaaactactttaaagttgatatggaaccaaaaaagagcccgcatcaccaagtcactcctaagccaaaagaacaaagctggaggcatcacactacctgacttcaaactatactacaaggctgcagtaaccaaaacagcatggtactggtaccaaaacagagatatagatcaatggaacagaacagagccctcagaaataacgccgcatatctaccactatctgatctttgacaaacctgagaaaaacaagcaatggggaaaggattccctatttaataaatggtgctaggaaaactggctagccatatgtagaaagctgaaactggatcccttcctcacaccttatacaaaaatcaattcaacatggattaaaaacttaaacgttagacctaaaaccataaaaaccctggaagaaaacctaggcattaccattcaggacataggcatgggcaaggacttcatgtctaaaacaccaaaagcaatggcaacaaaagccagaactgacaaatgggatctcgttaaactaaagagcttctgcacaacaaaagaaactaccatcagagtgaacaggcaacctacaaaatgggagaaaatttttgcaacctactcatctgacaaagggctaatatccagaatctacaatgaactcaaacaaatttacaagaaaaaacaaacaaccccatcaaaaagtgggcgaaggacatgaacagacaattctcaaaagaagacatttatgcagccaaaagacacatgaaaaaatgctcatcatcactgggcatcagagaaatgcaaatcaaaaccacaatgagataccatctcacaccagttagaatggcgatcattaaaaagtcaggaaacaacaggtgctggagaggatgtggagaaataggaacactttttcactgttggtgggactgtaaactagttcaaccattgtggaagtcagtgtggccattcctcagggatctagaactagaaatcgcatttgacccagccatcccgttactgggtatatacccataggactataaatcatgctgctataaagacacatgcacacgtatgtttattgcggcattattcacgatagcaaagacttggaaccaacccaaatgtccaacaatgatagagtggattaagaaaatgtggcacatatacaccatggaatgctatgcggccataaaaaatgatgagttcatgtcctttgtagggacatggatgaaattggaaatcatcattctcagtaaactatcgcaagaacaaaaaaccaaacaccacatattctcactcataggtgggaattgaacaatgagaacacatggacacaggaaggggaacaccacactctggggactgtggtggggtggggggagggggtagggatagcactgggagatttatctaatgctagatgacgagttagtgggtgcagcgcaccagcatggcacatgtatacgtatgtaactaacctgcacaatgtgcacatgtaccctaaagcttaaagtataataataaaagaaaaaaaaacttaaaaatttcagcaaaccaaaatgtttgttaaaataaccattaaccacatatatatccaaatattcattatatataaaaaatttctttaaaatatcatgctcataaatagagtaagttttaattaacaggaaaattgtttcatatgttattatctttaccaaaaaataaaaatcaccaccaccaccaccaacagcaacaacaaaaggggggggacataaaatctatataattttttttttcttgaaaactcagcccaaatggccacctggtgcttcaagacgtgaagtgtgaatacatgtttcacttggaataaaataatatcttttcttatttacatccagatttcaaactccattttaccttgaacacaaagtaatgtgatttagtgtgaggaaagaaaggaaagctttttctatgaaaatgactattttatggtattttctaataattaggtcttataaaacttccccaatgtttttactacaatgctggtagaccacagccagtctgtcttgctccaggatttctgatgatcttattccattaaaaaaaaagactccacaagtcttgaaaactaaactatattagcatgtagttttgggttgatacaaacttctctcagctgcattcccattagataaaactgaatgatgcattggaaacttggaaattaaaaacatgtatctgtggcagaaagataatactgcacacaccatttttctttttgctgcttcactaaatcagttgatgctgaacacgcaataaggtgtataggccaggcccacagctccttttggtcaggtgcaattaggaactaatgttaactgtcttctaatgcgttacatcaatagtacatgaatgagtaataagctctaacttttgcaaaatatgtgaacaaattgatctactactcacaaactcattatccaacaaatttatttttgccctcacaaaaaataaacttataactgacaaaaaaataaaaaagaaatctgatttgatataacaggaattttaggaaaattaaagcattactaggagattcaaaaacggcttcatatagagttgataccatataaattgggtctatagaagcaaaagcctatagacatacaggaagctgtaattaaggtaatgagactagagctcaagtgaaatatgggcaaaactgatgaataaacctgattaagccaaaatcacagagggttaccagtgacttggttagaagtttgaacattttctaggcatccaataatgtggttgcgtaggcacaggaataaaactgagtttggttttggatgatggactttacctaaggtgggtcttgttgcttttaaaatcatcactcccttataaagaaaaaaaaatctatgcagacatcccaaaataacattaagacactgggcttcgacatcagtcctggattcattcaaatccaatctctacttcctattagttatctgtataatatgggtaaattcctttctctcctcaacagtttgcttctacattttaatgtacatgtgaagttcctagcccttaataaagcaattgtaaggcttaaataagaaactccaggtaaagtagctggcacataataagctcatattaaatattagctattttcacaaactgatcaggtttcttttcttggactgccggtgacacagcagaactagtaatgtagattttaaagttaattgaatggaggtaaaactaggagactgaaaacttcttctacatgttcacttgtcacccgtctgcagaacagaattggagaacatccataataacacaaggaaagagttagcagagcagataaggtatacgatatagatgatatggatatacttatagatggaatatcatactaggaagctgtcccaaattcatagaaatgaatctttcaaaaggagaggtgtgaaattcactctgaaattcaattagaatataattagtgactgttgagaatacagttttgatagaataaatgaggcagaagacagcttttaagggattaaggagaaaatggatattaagaaaatgtaacttcaggcatagagaataacttcaggatgttttgcaattataatggttataatggctcaaaacttgccaagtcctgcactaaatgtttcaaatcaactaattcatttaattcttgtaacagtcctatggtatgaatacaattctcactttcattttctagatgaggaaaaggctcagggatcttaagaaatttgcacaagtttacacagctaaaaagtggcaaggttagttttgacccaggcagtccagctccagaacctatgctgtcctccctactgttcacatggcttctgagacaagagtagtgatttaaatttagaacatgtggccaagtcttttaccctaatgtggcaaaatcaggaataaaaaattaagtgttttagtattcattttgggtaaatttctatgagtgcgcttgaaaacagttcatgaaactgagaaaaacacaagtgtaagattaccataatacaaagcatgtgatcactttggaaaggtgtatactactatggaaaaggtataggcaatacttctagttagaatgatttggaaaaggtttgtaggaaagatattttaattaaattccaccagaggaaaagaaataatacagcaattttgggaaattattaacagaccagtggttggagattgagataaatttggaaacttgagaagtatgtggttgaaatgtgaccatggacagtcgaaagtaccactgttgaagtgttttccattgtggaatcttaagagaagagcttttatactttagggcagcagttctcatagtgtggttctcagacatcagaatcaacagcaactgggaatttgtgagaagtgcaaccgctctggctgtactctagacctacaggatgagaaactcagggggtggatcccaacactccctgttttaacaaacctctaggttattctgatgcatgttcaagtttgagaacccttgttttaagggatgtggttgccattaagtctattcaccaaagttccattcttttattccaggctcctgatagtatcttttactctgcctacttgtactttgatatggccatgtgacttacttcatcaaattaaatgtgaacagaagtgatgtgcgccatttccaagcagaagctttacgggttatcgtgtgctttcacatgttctcttgcgttcttaaagtttatattgagatgacccttctctcagcccaggtccttcagctgagtacaatgagttgagacgcctaccaatctatagtgacatgaagtttggcgggaagaaaattctattcttttgagtcgctgagatatcagaattattcttatagatgcataatgtagtgtatcctgatttataggggccatggtacagagaagggatctatttcatggtaaagagaacatgtgtatcaacagatttatggtatctatggaagaggaaaacatgggaatcactattaaacctcagaaaaaaggatcatatattgtcacataaataagagaggagaaagaacagagagaaggagaagttaatgaccaccaacatattaacaatatttatctttcggtgtaagaattttacatgaatatttactatattattatttaagcattatataatcataaaatagaaatgaatattataaaagcataaagtttatgacacaaaattggcctcgaatctcatcttttggagggcataaactcatggaagactttcttaattagaccattttgtgagtgtatttactacctcttgatctgtatccatgtgtaggacactgttttaagtacttcccatgcgttatttctatgatctttctcatagacttgctgggtaaaatttgttatcccaaggttggcattgaattctcaagtgtttacataacatgccctagattatacagtaagtaaatatatactcatggattcaaatcaagttatttatgactctaaaacttaagttcttttcattatagcatgctgttgtatgaagatttatctgagtctgtacctacccagatataggaaggtgtgtgtgtacgtttgtttaaacaagttagtatatttggtaacctttagaaaataagtgactcttgtatgtgccgagaaggaggctggtgatttatgctcaatgtcatagtgtaatagaatctgtaataatcataataacgcaagaaaaatctgatgactggacatagctaatcacacggatattgccactaaatgtacttccattttacaataaagcgatgtgataaagaatcatgactctttgagagggcaacagcgctgacatttctaggtcaaaagttttcatgagattatggagtacctaaacatgtacaattagcctccagatgttcacacatctgcaatatattttttcaaacctttgtcactcactgtcagttaggattcgaaacatactaaagcttttctccccctttttaaacacaaaatcctaaaactttaggagccagacttggcacatatattgttgtcgttaaggtgatatccatgagtccataagacgatcaacaaccttatctgtctgctggattgtacaaacagaattaatagctgccttaagatagagtttggctgaacgagtagtacttctgggcatataaatggacttcagagaagtccatgaattttctggtatcatatgcaaattcttttgtgtttgtacaaatgtgcatgagagggtccaaagcttttgtcatatctctaattggtataataccaacacaatatttggttgcatagtcctgtgaatatactaaaaacattgagttgtatactttaaacagatgattgtatggcatataaattatatctcaataaagctgttccattttaaacatgactagcctagaaccttttaaataaacttgttaggcaaaagttgaagccgcttgatgtttatgttactattagattggtgcaacagtaattgcattttcttgccattgaaagtaatggcaaaaaccgtgattacttttgcaccaacttaatatatttttagaatgtgtgttccatgtcaaatggtccaactcttgactcaatcccaactaatgacctgttcagtgcccttgactatggtgccgtacacttggctatggtcatgccactatgatgacctggttacacagctaccacccattccctttggtaacagataacacaccattctgatattgtcactgcatcttctggcttgtatcactctacagtaatgacacaatccaactaatatgtcttttatttttaggaggaaagaatgatgtgtttattccgttctaaaataaagccaatgtttttattaaatattcttcgtgcccactgggatgtgaatgccaataggataaaatacatcagagaagcctaaggattccatgagaacaaggaatcagacaagtaatcatgtgccacagatagactcagctggtggaagtgaaaatattataggtcaagatgcctcataggtaagaggaaaaatgcgaggtagagaagaccgggagttaatagtgtaagtttaagctgctgggcaaggccgaagcatgaaatattcagaagggatacacagacacccaagctaaagctcatctggacaatcacaagggtttagaggagagtaaatgggacaaaagaatcaggaatgagacctaagcaatgagaaaatgggaagtaaattatgaagatacaaggcaacacagacattgggcagtaggtataaggaaaaaggctggggccaagaatcaaggctttggcctgcttcccatatgtgtgatatttgacaagtaagtaatcttttcgaaattttcatgttctcttctgtaaaattgttacatgaataatttatttaatcctcactgcaatcctacgatgtagatactattatgatccccattttacagatgaagaaacgaaggccaagagaggataagtaagttgccagagatcacactgctagtaaatggcaaaatggagattcaaaccccattaggctggtgctgatgataccctgtctcttcctctgagtccttcgcatttcagtggacattgttccaacttccacctgccagctcctgcatctctttgcctactggagtctgttcttccggagtgcatgcaatagatcaaaaatgctagggagtgaatgcacagcccctcccgggatctgccaacagatgaccagcaggagttggtgtataaataccttagcattctcatctcttcaaaggataagtctgaggtgtgtgttccacataattttcttcaagtccccagtcaaattgagcgccagttgtccaccacagtttaaactcttgaaatgtagtcttcattgactttccttccttctttgtctcactttatcattttcctactcatattccctagcatctcatcccaaataaactagaagggggaagtattctgaaaatcataaagacagggtaaatttaaactattattttattatcattattagtaacatcgatatctgagccaaaatcaaaaaagaaaggacccttatttgtactctttctggttaggattctaaccatgagtgttagaatgttgttggcactgaacccatagttacagtttccaataatttctgaatgccaagaaaagtgaccgtggaaggaaagcagagtttttaactctgtggaatgtgttcagtgggtgaggaatgggaggaagttctattttgctctcagtagaacattaaaaatggcttcctctgtaaagcattctgtggttcccccaagataagggcaggtctgtctgtcataaactgccatagcacccattacttatacaactaaataaaatagtattgagtgatgggtggttagtctctccaatgtagctctttttcaatgaaaatagacattgtgtttcttccagggcctcacacagttccctatatattttacataaaaaaatatatacctaaaatatttggtgcctaataaatatatagaaactatgctaggcacagggcagggtgtggtgatttagctagactatttaccctgtcctcataaacacacaaaatggatttaaggaacacatattcatctttaaaccctctctcaccagctagtaagcacactcagggcttttcagttaccctctacttacaagctatttctgaatcatttctgcaaccatcttctaggaaggataaccattcttacaattttttttttttttgccattcctccaaagttgctcttttgaatattatcaaaacttccaatttgccaaatctaataaactattttaacccacatcttacttaatgttttcagtggaatttagtacttaattattcctctcatgatcaaccctcccacctctctgccacaacctttttggtcttcctagcattgtgtgatcttggtgtcttcttctcataaggcatattctctcatggtttcaactgttaaatatgctaatgattaaaaactgtgcacctatctgctcaaacctcctttttaaggttcagattcatatacatggtggcctagtagacattttaccaaaagcacattaaattagacctaagaaaaatgaaatccatcttctttactccctccctccaaacctcgttatttaaactggacttctgttcacttgtgtaagacattatcatacagatcatcctagcatacttcacctccctatcctgtcatatctagtcattccttaagtcccatcaatgaatcttctccatcccaatcaatcctcttcatctgctttgtcaatactctaggttcaggatataaacacttttcatctggactattaccagtctccgaaaagatacaatttttctcaaatacgtatgattttagaagagattaccatcaggatcattggctcattatcttcagggcagtgatgcggggtgggagagttcttaaaggactgtattctacatgtgattatgagtcaaattttccagaccactgtagacacaatcttacacttcactgtttcacgcagctatgatacctacacaacaactgtaaggatgtgagtttgagatgtagattgttattgcagactaacaaccactccttgctaagtttgtttcaaaatggacttaagggggtgatctcagttgtttttggcaagaaaaaagtaattggcaagaaaaaagtaattggcaagaaagccagagaaagagaaagaggaaatgtttgttcagcccatgaatgagtaacattacaatgctttttataacttcaaacattcacccccatacaaatgctctataaaactattgtcatgatgatcaatcagcattttaagttgaaacatatatatccaagtttctgatcttgttctgtatcaacacagcactcacagaactcaggaaatccctatagcctccttagcttccatctttctcttgtcttttgaaataccttaaagcacaaaagcatattttcaggcaaaggtaaaaataattgtaggaatgatggtttcacagacagggtgtcttcagtgacagttaagttcctatggtgagacactgtaatgagttcaaagtgtttacagcttcaatactgcttgtcaaacactccttcaatgcaatgaattcttggctacaagccacaaatgtgctttgagaaataaaaagcgagtgaatatactggtgtttctattattggtccagctgagatagttgcttttttattcttaataaaagttttctcgaggtagtcataatttcaaaaccctgcttatagtaatgaatcatggttatttacaaagtaattcagtttcactatgatcacgatttgtataagtaatgtagtcatatagtcgaagacttttcagggatgttttctgtttaaactgataagctgcaaaattctgtattttccttaataaaaatgtttcaggaaaaagacagcgaacagctagatttgaagagtaaaaataaagaataaagccagtaggaaacacaaacttctagaacttttaaattgttaaacatctttgtggaagtaactaccattttcaccaaatctgcaaatcatattccaacaagttgtaaaaataagccataattcttagaattgaaagtctcttatcattctacaggtaataacatgacttggtcctgttctctgggtaatggagtaaaatgttactggcatattcccatgtttagacagatttgcaaatagccccagagaattccattcctaacctgggatatgttactcaaagacgttctatctggagtcaagctttcatacaagaatcatagacatacttcaagggatccatgaacactggaaagtatatggaaactatgttcacgttttttatttttcaagaaaatctacaccatccagcagaatctcacacagatccttaattttaaaatgagttaagaagcagtggtctagggcaggctatggttctcaaagtgtggatccagaccagcatcagcgtcacctgggacctttttagaaataccgaatttcaggactctcccagacttacttggttagtatctcagggagtgagacccagaaatctgtgttttctttttaatgtttaatcgacacataattatgcatatttaggaggtacagagtgatattttcctatatgaatataacatgtaataatcaaatcaggctaattatcatatccattacctcaaatatttgtcatttctttgtgttgggaagtttcaaaatcctctcttctagctatttaaacatgcacaataaattactgttaactgaagttaccttacagtgctttagaacactagtacatatccgtcctatttagcttatcattttgtatctgttaactagcttgtccctttcctccctctcctccctcttaccctccccggcttctgctaaccactattctactgcctgcttctatgaaatcaaactttttagctctaacatatgaaaacttgtgatatttatctcttcgtgcccgacttatttcacttaacagtatccaggctcatccatgttaccaccaattacaggatttcattctttttatggctgaataatattccattgtgtttatatgccatatttttaaattcatttatctgttaatggacacttaggttgattccgtatctcaacaatctgttttaacaaggcctccagaaaattctgatgtgcactcaagtttgagaacctctaatttgcgcaacaattttcaaatggattttttacaatgtctcctcaaattttgattcagttatgtttgggaaatatattttaaatcttcccaggcaattctgaggattaacctgtttgggacagctactccagggcaaagctactcaaactttagttggagaacgagtaccatcagcctcacctgggagacagttgtggctgcagaatcttgcccacatccttagacatactcaatcaagcgtgagagtgagacctagggatctgtgttttgctgggtttatttatttacttacttactgtatttgaaacaagatctcactctgttgtccaggctcgagtgcagtggcatgatcatgcactcactgtagcatcaaactcctgtgtttaagcaatcctgatcctcccgcctcagcgtcccgaatagttaggactacaggtttgcactaccacacctcgctaattttttttttaagtattttttgctgtgtttctcagtcttgtctggaactcctgggctgaagggatctgcctgccttggcctcccaaagtgctgggactacaggtgtgagccaacatgccggggaggaatccgttttaaccaccaccttccctgatgactctgatgcaggccacactttgagagcaaagcacagccacagaaaaaattagaaaagttgactattcatgtgacacaaaggcatatagctatgccttctatatgtaggctttgaataacttttaataatagtaaaaaagccaggatagcttttaataatggtagaagctactctttatttggtacttactatatgacaagcacaatggtaatacacgtatttcccttttatccttaaagaaaaagtgtaggccaggtgtggtggcttacacctgtaatcccagcactttgggaggctgaggcaggcagatcacctgaggacagaagtacgagaccagcctggccaacatggcaaaaccccgtttctactaaaaatacacgaattagccaggtgtggttgcggatgcctgtagtcccagctactcggggaggctgaggcaggagaattgcttgaacccgggaggcagcggtagcagtgagccaagatcatgccactgcactctccagactgggtgacagaacaagactccgtctcaaaaaaaaaaaaaagaaaagaaaagaaaagaaaaagaaaaaaggaaaactgcgagggtggggcatttaatcctgttatacagataagaaaactgaggagcaaaaagtttaattttcattaagtaccatagccagctggggtatgagtccagtttgaaagtttgtgattttaataattacatctacagaacttcagaaaatatattttgaaatgagtcttagggctaggtaaacccatgcattacatgtattattaaagggaaattaagaatgatatctcaaaccataaatgatggtattaggtaagtcagtaagtatatcaacatgcaaattaaaacagattatcaatacatagggattgactaagtataatatggcaaccaaattatcccagaattgccctctcaaagtaacaagagcttatacatgtgaacaaattttacacattctgtgatgtaaaaagactgtgtcatcagtcattgcagagaaccaggcagcaagtcacttccttacaattgttcacagctctctgattagctactttgcctgaagcataaaacataagcacattcttcctcacctctatgggtactaactggactgtttaatgtgatggagtaattaacagaaccttttctcccattggggacctacgtggcaagtgccccattaggtcctaggtacatacagaacccaaaaaatagaagccaatgtggggaggaaatggaactcattattttatatgctatggcacgatttcccccctaccaaatttactagactgattagtaaatgtaagccaaaatctaaggtgtgattgaatcactataatatccatcccttgagaactgtgactcagcagataggaaaagagaaaactaatgtccaacatcttgtcactgacacttgtgaaattatcatttgacaaaccatgaaataatttggcaggaatccaatacaacaaatgagtcatttcattaaatacaattctgtctccccagctaaatggtatgcaatgataagatcaccattttaatagttatctagaaatagatgcctaaaattctttcctttatgactttttaacagccaacctgagtacaataatgatattatccagaatttatatggtcaacattcaattgctcacaaggttattaaacagtttataaattatcctgttttcttcccctgctctctgctcctaagaattacatttcttattagaattttcctaaggaaatggaaagaatgaatggaaatgaagtggaaatgttcaatatttcaagttcttaacacgtttggacattatttgaggatcctggctaaagccaagatttgctgaaggcttttagggttcccagttgctataatctctttaagactctgataattgaggtagacaccaaggcagaactacgtaaaattatcatgtctgtaaacaacaaaaaaatgacacacaattaaaagccaaaaaactcattattgaatcaatagtgagaatttatgtggctaacaccacacatagcaaaaaagatttgatgttaggtattaggaattgcagctgttatatgaaccaatgaatcacaatttgttcatattaagacataggtagttatatacagttcactgatcttttttgaaatgtgattgtgagccatttccattggatgaaaaaacagacgccttgccttatttgtcacttttacccatgaaacctagtacatttctacatatatagaagacactcataagtgtttattgacttgtgatttacaacattaagaataaacagagatttttccctaacggaaaatcatgtatattgctacatttatgttaatcataaactctatgaaaactagcatagcattagagttagaaaactgaatcatgtctatcattttcaaactctatccatccttgagaaagctagtttcttcagattaaaatataaatacatttaaaaattctgacaaaagggagaaaaacttcccgtgtttcatatgaagttaggcgaaatttgatttacatttggaaagaagagaaatccacttattttagaagtaaatcaagaaatgtgcaaaatatctatcaggtatgaatttaaaatatgatattcattcaataatttataacagattgctataaatcagatacctgtattgtatttcttccctgtgtcaggttttggaaaccacagagaagtgcatatgacagtgacaggaagcagagccaaactcctaggcagataggggtgggtacccagtgaaaccccacttccaagctgaagacagttaaaggcctgaaagccaaactacaaatcaaatccttgcagtggattgagaacttgtcctcctatttggtgtgctttcctctgattgatctccacccttcacctattttacttatacctactgatatggtttggctgtgccctcacccaaatatcatcatgaattcccacatgttgtaggaaggacccagtgggaggtaactggatcatggggtcaggtatttcccgtgctgttctcatgatagtgaataagtttcacaaaatctgatggctttgtaagggggagtttccccacacaagctctctgtctgctgccatccatgtaagacgtgacttgctcttccttgccttccagcatgattgtgaagcttccctagctacgtggaactctaagtccattaaactctttttcctgtataaattatccattctctggcatgactttatcagcagtataaaaacaaattaatacagtgaattggtaccagtagagtggggtgctgctgaaaagacacgtgaaaatgtggaagcaactttggaactgggtaacaggcagaggttgcaacagtttgagagctcagaagacaggaaaatgtgggaaagtttgggacttcctagagacttgaatagctttgaccaagatgctgataatgatgtagagaatgaaatccaagctgagatggtctcagatagagatgagcaacttgttgggagcccgaacaaaagtgactcattatattttagcaaagagactgggagcattttgctcctgccctagagttatagggaactttgagcttgagaggggtgatttagcgttatctggtgggagaaacttctaagcagcaaagcattcgtgaggtgacttgggtcctgttaaggcattcagttttaaaagggaaacagagcataaaagtttggaaaaattacagcctgacaatgtgataaaaaagaaaatcacactttctgagaagaaattcacgcccactgcagaaatttgtataagtaacaaggaactgaatgttaatcaccaagacaatgagaaaaatgtctccagggcacgtcagagacctttgtggcagcccctcccatcacatgtctggagtttaggaggaaaaaatggttttgtgggctaggcccagggtccctctgtggtgtgcagcctagagacttggtgccctgtgtcccagccactccagctgtgactaaaaggggccgaggtacagcttgggctgttacttcagagggcggaagcccaagccttggcagcttccacgtcgtgttgagcccgcaggtgcacagaagtcaagaactgcggtttgggaacctctgcctagatttcagaggatgtatggaaaaacctggatgcccaggtagaagtttgctgtaggggcagggccctcatggagaacctctgctagggcagtgcaaaagaaaaatgtggggttagagccctcacacagagaccctactagagcactgtctattagagccatgaaaagagggccactgtcctccagaccccagaatggtagatccactggcagcttgcaacacacaccgaggaaagccacaatcaatgccagctcatgaaagcatccaggagggaggctgtaccctgaaaagccgcaggggcagagtggcccaagaccacgtgaacccctctcttgcatcagcatgacctggatgtgagatacgcagtcaaaggagatcattttggagctttaagatttgacagccctgctggatttcagacttgcatgtgccctgaagcccctttgttttggacaatttctcctatttggaagggctatatttacccaatgcctgtaaccccactgtatctaggaagtaactaatctgcttttgattttataggctcacaggcagaaggaaattgccttatctaggatgacactttggactgtggagttttgagttaatgagggaatgagtaaagactttggtgcactgttgggaaggcaagattggttttcaaatgtgaggatatgagatttgggaggggccgggggtggaatgatatggtttggctgagtccccacccaaatctcatcttgaattcccacatgttgtcagaggatccctgtgggaggtaattgaatcatggggacaggtctttcccatgctgttcttgtggtagtgaaagtctcacgagatctgatggctttgtaagtggagtttccctgcacaagctttctttgccctctgtcattcctgtaaaatgtgacttactcctccttgccttccaccatgattgtgaggcttccccatccacatagaattgcaagtctattaaaccctttttgctgtataaattacccaatctcaggtatctctttatcagcagcatgaaaacggactaatacacaagcactgacttctccctgcttagaacacctttccatccccacctgtattttcctccctcatgcctttaccctcttccttctccacaacaagctagtacccagacttccatctaaatatcacttccttcaaaaagacttcatttcttattcctccagatacagattccctgatttactatttttatagcactctgaattttaaatagtacacatcaaaaataaaattaaactattatacaatcataattatgctggtattcctcaaaagacaatatattccaagacatgagccttttcttatgtcttcaataaattcattcaggcctaacagaacactttgcccataggaggtgcttaatgaacatttatggaatttatagttcttccagatgtggttcgactttgcattgagtctaccttagaaatttgtttttcatactcataaagatttcctatttgaccaccacaaaccctctgcactgccactcatagtaagccacacagggagtatactccaaccaagcttcagtacaaattcttccctcagctgtgggtgttctataacatttaattggctttcttaaaatctgacacaaataactaaagactcttgatgctttgtcagagcaaaggagtgtgaaaccattatctcctctaaatactacattatactatactttgtatcatatttctgttaatttagcatttttagaatatttataatacaatgttagttctccctttctgtacttgcgtctacatgttaatatgttcttgagggaaggaaccgagccttattcacctttatataacctagcaagttgaccacatggttggtgttacataacaagccattgaaaataaagcaagcaagcaattaagaaggtaccaaaccctgctcaattctattttgtgggttttgaccccgtgatttagcctatcatgaaaaattctcatcttcattttgaccccccacccagatttgtgccatctgcaaaattgaaaattacccctttgctgatgttatgtaaggtattgatcaattattcagcagcacagaacctgtggtagcttactaattataataaaacaatatttagagttgctggtcacttaatatctaccaagcacctttttaaatacttttacatgtatgtaactacatacatacatgttaaacttaaatattttcaaaacaatcttatcagatggatacaattatcgccattttacagatgaggaaactgaaacacagtatgactaactttctgagggccacacagcttttaagtaatacagctaggattcaaacccaagcagtgcatctcaagatctcagacttttaccactctgccctcctgactaaaatgtgtattctatatacagagctcactctcccaagtcaatatggttattaattcctctgccaactctgtcatatagatcacttatcaccatcttatcccgataccatagaaccttagccactgttttactcaaatagaaataaaccattaaaaaaaaaaaataggtgccacagtaaaagtatgatctcttcaacctgatgagaccatcacaaccagtctcaaaacttcttttctgaagaacaagctattaatttagatgaatgagtcaataacaaacttatcgcagatttaaacatacagaaattttcacggcaaatctgtaaaatatgaggtcaataaatatctaatttatactcaatagcatttatactgttatagaaatgatgcaatatacaagacacataactgtacataacaccctagccattaaatcattgtgcagatggctcccactatcattgtgacttctgtgcctctttccccatagtgtttgccaagccataagctgatattttattttaccttcagttctctgtacattacagcttctctgcctgcaacatccttttcatctggctcctttacatgtcaggtaagttaccactgccccttcaaagcctttccttacggcctgagttttggttcaatgcatgacctgactgtaaaacactatttcccacatcatgtatgtctttccctactcatcacattgctgaagaattgcccatgtatctgcttgtctcccatgataaggacaatgtctttttcctttataacataatgaggagagctcaataatgaaagctcaactttttttttgtatgggtgaatgagtagttctaagtaaatacagtaaatttacttacagtatcaatttcaaagaaattctctcctctaaaaatattgtcttcagacaaggaaaaaaaacacaaaaaacggaacatgactaaaatcttaaaggaagatacggaagtgagcacacaatccttctgaagttaaaatatttctataaattcatatagctgtattctaaatctttttggtaagaatccctgaaatgtattctgaattctaatagatgaaaagttccctgtgggcaggtaatgtgtttactccaactaagagcagcccaacacaggaatatttgctctttgaggagtaatacatgttttataactcaatgatgttttcatattcttgagttcttaattacaaatattttcaaacaatattcaattatttgcttgccaggtataaaatataagttaaatagcaataaaaatatcaatggtttgaatttaataacatgttttttccttagcactatattttctaaatagtattagctacttaattaaacttttcctcaattgggaagtgatcaagaaaatggttgtgtatcaaaaggcagagtaagtgaaaacaagttggttacaggaggaagcagggtatgggtttcgcttgtgctatattaactgctccactggagcaaactaattaatttttcttcattgcactgtaatcagcaagcttaatctagggcaaagaagaatacaattgtgattgcaaatattaaggtcttactacctgtcattcagttgcagtaactacagaaagtctattcaataattaatgtgctatggctattggctttgttttgttattgaatacatttattttaagcagcattaagcgcataaattaaatcttagtaacattttcatataagtaactatcattaaaatgcatttgttccacagaagaaagaattatctcaccattccggctcaacaagaaattcagtcctgaacagacaaaaaagtttaaaaatattttataaacattaacctggacttttcgtagaagaaataaagctgagaacgtcatatttcagcagcttcaatacttgttttctgattgaatcataaatttcattactttatacttgcttctacaatgacaaagtacccaaagctaaatgtgaatgtctagtaggtcagaaaaatgtgtagtcgaatatggtttttgatgacaataaaatcgctaaaaaccaaaagcattcagagagtgtaagagaacaaacacatctcttcaaatatttaaataaccctatgggcaacttgatatgatgtcaatattatatgtcttacgcatctagtttataaaagtcatcaggaaaaaaatacaagattaatctccttgtggatcaatttgggaaacaaatgaataaaaccacagatctacacatagatagagggacattccaaggacaatcactacttcagcctttaatcttctggataactggtgaaagccttggcaggaagcactccaagctacttattaaaaaggtaagaggatgttcttatggatacaatcaagtatatatcaaaccatatgctgtcacttgccccatctacattttcccaactttacagttagaattaagtgatgcaaaacagcttaagagaggatctgatggaaagcaaagtgccctatatccctccacagctcatcactggtttgaagtcaggccataagttcatggtgacatgaaattctcttcaagaccaaattagtcttcgtcagcaagaaattccctacaattcagggtttaactcttaaagagattagctccattttttttctaatttcgaatttacttaacatgacaaattttatatatttatagtatacaatatatcttgataggcatatacatttaaaaatggctcaatcaagccaattgatatatccattacctcacatgcttgtgagaacatttaaagtctattctttttgaaattttcaagcatacaatacattgctattaactatagtcttgttatatacacccaacagttctcttgaatttccctctccaacctaactgaaattttgtgtaaccccattcttaacaagttatatgattcagggatataatagaaaatgttgagacatacacattctatctagttttagcccaactttcaaggctctccagaatttcctctactttgactttataatttttctttcgattctgatatggtttggttgtttcttcccccaaatcttgaattgtagctcccgtaattcccaccatgtcatgggagggacctggtaggaggtaactgaatcatggcggcaggtctttcccatgctgttctcgtgatagtgaatacgtctcacgagatctgatggttttatacaagaaagtttcccggaacatgctttctcttcttgcctgtctccatggaagatgtgactttgctgctcatttgccctccaccatgattgtgaggcctccccagccatgtagaactatgagtcaattaaacctttcctttataaattacctagtctttggtacgcctttattagcagcatgagaacagactaatacagattcctttataggtttattttgaacagtagatgcctctttgtattttgcactgtatcccatcaacccatctctcatttttgctgcagttcctgtttctgctgttagagggttaacaccctttcacttcctagctctagcaacaggaggaggaggaggaagaggagggaggaaaataaattgtccttcaaagggacatttctgaggacagttctataaggttctataatgtcccaggcaaggttgaggtacagttacctattatggtcatcagttcaacaatgttatctttattagcttttccttcttccttgtctcacttttccaggtcccacatgttcctgagttttcttactagtttctttgataatcagccaatcatggctttctgtcaggctttgctttgggggaaaactcaaactgacactcttgactattgctgtcacttaaactgaactcttagagagcagtggtgatacattttaattctttagctttaggggccagagagggaagatgatgcagacttctcaagctcacgcagctctagatggcagagactgcatttaaatccaggtctttctcctccctgcgtgttgctacatgccattttggtacctctctacaggcttgccttccataacctttcaaagttcagcattctcctactcatccaaatgaacacagtagtcatgttttattccatccacttgataaaataatgggtcacagcacagcacttgatccattgttattcaacgaccaagactcttgagttcctgtaattatgtaacaagccccttaactgtcagtggtcataaaggcaagaatctcagacttcggaatcaaaccccccatttactcttactgcaatttgccctcacacaggtattctcaagattacgagataacaaagtgtaagagcttagcacagtgcctgaaacacaggatgtgttcaataaagggtggctattattttcacctggagcaaaacgaccacaaataggggccatgtgctccgcagcatcccctgcctgtctcccaaagccagaacaatgagaccaaataggcgtccacaaacaaaacagacatgtaaaatgaaaaaaataaaaaagataaaatgccctcttttacttcatctgtatgtttttcctatgcccatccctcttctctatttcgaaacatgctctcacattgttttgcaactgggaatactcattttatcttatccaattctaactatctttaagtttcagctcaacttctacttctggatgtttcctattttccatcacagcccttgttgatttctctcatatatttctacagcattcatacactataaagtgaaatttactacttcacaaataattttacttcagacctattgaactattttggtcagtcctgactctcaagttacactgaaagttgctagaaggaaaggatcatttctaatttttctctggggtcctctggcacaatactaaacttatcaggcactgaatgcttaatcctgtagacaaaatgtggaagtaacaaagacaggactcaagaaaaacctaatttactcttctctttctcattcccccttagatgcatttctatattcaatgttcattctgatttccaggtagcactttccccactttctttcctagcttaatcctttcactgctcagcaatatgcggcacacctggcaacatgggagagatgagttagttactgcaaaattgtttgcttgttctcttaatgccttacctcaatttctctatggcaataaggctatcatatccaaacagaagaactaagctaaatggattcatcatttcacaaagtgattctttagcaattttcttattattttatatatttttggtttcatatataatgctacctcagaaattcagatatgcaaagtttaaaactccttttttaaagtttcagagagctacaactacagacgagataagctttagcttgatgaatttcatactgactactggatcttatgtttaaggcagatgcaggtttttcttggggggggggggggggcgggggaagacccaggcaggcccatgtgatacatttcttcaggattctaacaattttccactcagaaagtagtccctcaggaaattattaactgtaaaataagatagaggataaaaaaagaattctgaagcagaaaaatacatggaatcagaagcaaagatgctgaataaatctgcattgaaaaatggaaagttcctattttgtgtttatattatacttttgactcttgtaattattcttcttaaatgtcacaaaaatccccccaactattactattccactgctatgtatgtggagatgtacatacccaattattaggtaacgtacccaaggatcaattagataataaaagaaacattactgtaacacaggacttctttttacactaccttctattaaaaagaggagacataagtatgtgaaatggaatcagtatgccacatagtatttaacagcattattcaattgtcatatttgttagtacctcatgataaatgttaggcagaaagccttctctatctctcttcaccttccagggcaaatatctgccctactttgttgccacagagaataaattttccatgactgcaagctctattgaaaatagaagagaaatggaaaggtccagaatttaaaggaactgtatctctctcccattctactgtatgtcccttgagattagagacatttgtttccccagtgccaatcagagacatgatacatagtgttcaataaatgcttggtgaatgaattggtgaaaataacttatgaattatggttgcaggagggaagaacagagtgatataatgttaaacatattcaggtttacttgcaaggaatgggaaactgaatacttcatatattgatgttgcatataggcatcattatgatcatttggaaattagtcaaaatgtctttaatgcataccttttgatctagctatcctgggttcctagcatgatacctcatatataaatgcacactcgatagctttttgtacctcacataatgacatgattttctataccttgaatatgccttcctcttatttcttcttcattggtgcttttgccttgctatttcacctggaatgctattcttccctatttctacctatcaaggcctttctctaaaatatagcccaaatgtactctccgggcattatttctctctctctctcaagtgattgcaatgcctttttatttgaactctttggactacacttaaatgttatcaactcatgtccaagatgtttacaagtgtcatttgttcctgtgactttaataatgttgtctcctttttttgcagcgtctatttaattttatctcttaccataaacccacctggcctatccagggatttcttcaagaagcacagctactgtatggcacattctacactaaatccccagtatataatctgctcatttagtgataaatcggtgatgctcttcacaggagactgaagagagacactcagaagtcttagaattgtgtgcttctagaatacaaagaatttccacaatcatagagtctgaggacttttaatcattactattttcacagcttttggagtagacagactcagtccccagaaaaatggccaatgtaacttatacacacacatacacaatgatgatgatgattatctttaaatgtgacaggtccacccagtagatttccatgtggaatcaaagtcagatgccataaatgactggagtggcagagtctgtcagtggagttacataaactgtgtgtatggcgagtgcagctccagactgaacagtaatgtgcccgctttgagggaggagagtagcactcctcagtactaccaggatggtgccattgcagaatgttgccccagagctgctagatctgctaacagaaacccaaatctgtagtaaggtgtagatcaaacaaaacatatctctgggttccttccagactttccattaacagtttataacgtcttctgaactatctgttcacatacttaaacctgagtcctcgggctgggcatggtggctcatgcttgttatcccagcactttgggaggccgagatgggcagatcacaaggtaaggagatcgagaccattctggctaacacagtgaaacccagtctctactaaaaacacaaaaaattagccaggcatagttgcacgcgcctgtaatcccagctactcgggaggctgagacaggaggaatcatttgaacctaggaggcagaggttgcagtgaggccagatcgtaccactgcactccagtctaggtgacagagcaagactctgtctcaaaaaaagaaaaaaaaagaaaaaaaaaatcaaaaaaaacaaaaaaaccctgagtcctgactagctctcctgcaggagagtgttactgagttaagcaatcaggagaaatgaaactctatcaaccgatggtcacctattaacaaataagatggcatacttctgtactattgctattcatttatttatccattccacaaacatttttcacctaccatctcttcggcattctcctagctactggctatacagtactgaagccaacggacaaagtccttgacaccaaacattctagtaggggaagcagagaagaaataagctagataatcaaacaaggtaatttcagataatgatgatgattttaaagcaagaagtgtgaataggatacaggaatggctgggagggctcatcaggagagctcttttacatatggtagactgcaaaggattcttctgaagatgagacctttcggctcagactgaatggcaggaagttgtcagctatataaagagggagaagaagtatgttcttgcttgaccggagcctggtgaagtaagggaaccagtgtgaagtgagatcaagaagcaagcaggggacagatcacacagggtcttgctggctgctttcagactccagacatttttctaagtacaatgtagagtcttcagaaggtgttaaatagggaacacatgacctaattaatgtagtaaaaagataactttgtataatgcgaagaactgagagactgcttaggaagttactgcaatattaggaggctatggaatatgatggagtgtcagtggtgcttcctttgaataaaagcagcttttatttttcaattaaaatgtaacataattggtttcagtaaaaatgtctcagttgaccttatttctcctgcattaatggggtcatttatatgatatgtcaggagtgctaccgctgtacacaatgaacagcttttttcaattaaaacgtagcttaattgacttgaaccagaaatgactcttgacatctttgtattaataggaccatttctataatgatcatgctaattaatcttcttcattcaaaagtattgtttattcagaattatttaatacaatcgttatacttttaaatcattttaatgttattaaatattatctcaggatcttgaagtctattggattgttatgctgatttaaagagtgcaaaaatatttatagttatgttttagtttaaagcagtgattaaatataatttgcctgtgaccctgtaggccaaaataatgtatcacgataaactgtagatagtgtcagagatgaaaacagtgtttgtctgctttagtgtattcatatgtgaggatgaattttggcacttgtcagcctatgagaaattactactagactaatacttgtcagtacagtaacaactcatcatgctctaaacaccactaagggagaaaagtgatgaataacatacaaagtaaaaattttcacaatcacattaatgactctagttcaaagcacagtaatggtctaccaaccttattgtccaatctatatttcaagtgtctaccttgatatctttcagaatcaattttacgtcaaattccaattaacatagaaaaaaagcagtagcgataaaaacatgtctctattgacttttccaaaagcaatcgtgctctccaaaccccagcctcatttactattactgaagcaaaacgaaatactaagagtactgtgtgcaaataaaaaacgtttgttgattatctgttaaaaaagaccccaaattaaaaacagcctaaataatgagtattacccgcacacaacaacagtatgctatggatttataaaattatcattcttcctaaactgataacgaaaatctttaaaatgaataaaatgttactaatatatttcacagtatgcactgaatggactacataattccatttgggtttaagttgaggttttttttttttccaactaaatggttaaaaattatgtttagagaacaatctggaaaatatatactcacagacaataggcatacaattgacaattgagcacaactacattaaatttacactataaaactcaatcatccaacacttatgaatccaaacattttctaaaactttacaagaaagcttataggtttttatcatggtaaaatatatataacataaaacatataattctaatcatttataagcatacaatttatcagcattaagtatatttaccttgttgtgtcaccatccccaccatccacctccaaaaattatcttcccccaaaaaacttcatatccattaaataactccccataccttctctcccccagcttctagaggccaccattctactttatctatgcattttactgctctagatagctcatacaaatagaatcatatgttatccttttgtatctggctttttccccttagcatatcatcatcaagattcatccatgctataatgtgtgtcagaactttcttaaggctgaataatattctactgtatacatttaccacattttgtttatccattcatcttcagatggacatttgagttgctccatcttttgctactatgaataatgctgctataaacatgggtgtacaaatatattttgaaggtccttttttcaattcttttgagtatattcccagaagtggaattgctggatcacatggtaattctacgttctatattttgagaaaccaacatatttgtttccacagtgactgcaaggttttacattccctccagcagttcacaagtgttcaaatttttccacatcctcaaccatatttattttctgggtttttttttttttttttggtgttttaaaataatcatcatcctaatgggtgtgaagtgctatctcatttgggatttatctgcatttccctaatgatcagcgatatcgattatctactcatggtcttactggccaaactttagagaaatttctgatcaactcatttattcatttttttaattgctgtttttctgttgttgaattctacgatgatataatttaactgtgtccccactcaaatctcatgttgaattgtaatccccaatgttggagttggtgtctggtgggaggtgattggatcactggggcaaatttctgatgaatggtttagtactgtccgcttggtactattctcgtgatagagagttcttatgaaatctggtcgtttaaaagtgtatgacatctccctccacccctcttgctcctgttctgaccatatgacctgccaggtcacccttccctttctgctttatgtttcctgaggcctccccagaagccgagcagatgccagcatcatgcttcctgtacagcctacagaaatgtgagccaattaaacctcttttctttataatttacccagtttcagatatttctttagagcaatgcaagaatggactaacatataggagttcttggcacagtctggatattaattccctattgaatatatgattcgcaaacatcttctcccattccgtaagttgccttttcactctgatggtgttcattcatgcacagaagtttttaatgttgatgcatttcaatttacctaatttttctgttgtagcctgagcttttagtgtcatatccaagatatttaattgcccaatctaatgtttatgttttcttccaaatgtctacgctttcttctaaaagttctgtacttttggccacgtttacttcctgatccattttgacttaatttttgtgtattttataagagtccaacttcatttattttaaatgtatatattcagtttcttagcaacatttgtggcttcattaaaaaatcattaaaaaaccttggcaaccttatggaaaattgtttgacaatatatagtagagtttacttcagggctattatattctattgttctacattccctttttttaagccaataccacagtgttttgattatggtagctttgtagtaagttttgaaatcaggacgtatgacccttcaacttcattcttttttcaagatcgtttcaactattcctggatccatgagattacatgggaatttttgatagagttgtctatttctgcagaaaaactaattgggattttcttagagatggcactgaatgtgtagtttgttttgagtaactcggatacctcaacaacaatattgagtgttccatttcataaacctggggttccttttcatttatttataaaaataaatgtttaatttctttcaggattgttttgtagttgtcagtgtataagtcttccaccttcttggttaattcctaagtattttactctttttgttactattttaaataaaattgtttccttaatctcctttttggactgcatcactgttagtgcataaaatataacttatttctgtatattgattttatttactgcaattgtgcttaatttattagttctagcaggttttttgtgtggaaatctctagaattttctacatataagatcatatcatctgagaagcttataaaatttttgcatacactctttcaaagctgatttttctgatgaaaatttgaaatgcattgcacagcatgaatatagttaatagagtattgctcatttcgaagctgctaagagagtacacttcaaatgttctctccacaaaagtctttgaggtgatagatatgttaactagcttgatttaattactccacattgtattcataaattctaccatcactttgtatgccatatatttatacaattatatattgtcaatttacaataaaaagaggcatataaaatttgcattctcttaaagtctttaatgcttgccaacaccatttctctgattcaattcaagctgtccaatgccgcattaatacataccattaaacaaaactactccgcattataggcatagtaataggattacatttacctggcttccaaccaaaagcaacaccgctaacattaaaataaaatattctcatcatgaattagtaatttcatattaacagaagctaaaggcacctagtattttttgaggctcatttgcatatgggtatatactcagatttcttttccaaaaaagtagccatttaaagggaaccctggtgtaaaatttagaaaacagatgtagaaaaatcataaaatatccaaataagtttttacaaaattttcctatgctatttcctttatattttctttagtccatctccatttatgaattattcaggaaaaaaaaccccaaaatgattttccgtgttatagaagatcatactccaaaattgaccaaaaagcttcatttgttaagactgtaagttctatatgtgccattaaacatacttactttttctagacttatagtcccaattctgacgtttatatccaatttagagtgtcagactatttcttctctcctctattttagaggcagtctgaagtctttcaacaagaaaattttgtaatgaggtgggtttttttccacttagtgtttgatcaggaacaaagcatctaattacttggagcccattttctcatctggaatattaagctaatgctattttgtcaataggatttttgtaaggattataactagtctataaaacattatgcaagtatttgattctactgtcacaagaaccgatgctttcaaaaatacattaattcagacctcaacaccaattagatatataagcatttatgtgttatacctgatgctcatctatatatatacacaccctactatgtgtctgtaaatctctgtttgggagaaaggtgcaatacaccatgctaaagaatcaattattttcataaaggcttaactattgataagagatatagatataacattgagtgtttcacaggagttacacacacacataactttattcaatttccagcaatgtttcaactaaaaatattctgtcaaagtcaatttacataatggtgagattaaagtaaaactaagaaacgtcagtggataccagtagaatatgacagtttattaattttatttataacacacaaaagaaaaatatgttaaaaaatgaatatgctatcttgcaaacactgtctactatggcagacactaagaaaacttatttaataacaagactgaaattagatttccgtcagatgctgtctttagaatttggggaatagagctattcatccctggatgtgtttcttggagatgtgtcaatatcgtaacaatgaaaaacaaaattgctttataccgttagatatttctgatacaatctttgcccactcgtgggtttcataaagctttgtgccaattttgtcaccaagacaagtgtatctgatctaacacaaattgaacacttttcagcaaagcattgtgtatattatttaattccccattcatatgtcatgaagggaaccagcatggttaccacaataaatttatttaaatcaacaaaattcaatgtcagaatgtatcatttttttctatggtatacttaaggttccattaaatttactgacattccttcattttagaaattataatcccactgggaccacgattttcttaacatagaattgaatctaatggatattttcctcttattgacttgaggtaattaagctccccattgagaagaccaccagatagttttatttatgaagctgatagttcctaactatggcagagacaggctgtcaaacaaccatgtcctttctccagcttttaaagtatagatttttcacttagaagcagccactcagccagccactgcattatccttgtagacaggcatggctatatacatgtttcatgagcacacatccccttcatgtggaaagtgaagggagcacatatgcatcacctctaccacaaggcttctaagaagtcactgtggcttttctgtatttgcttccccctcttcaatggctatatgaaaaaacaaaaaaacaaaaaacatcatcatctgtgaagaaggtagagccacaacaaaggcagaaaaatatagaaaaatattagtcactgtaattagtccattttcacactgctgataaatacctgccgagactggacgatttacaaaagaaagacgtttaattcatttacggttccacgtggctggggtggcctcacaatcatggcagaatgcgaaaggcatgtctcacatggtggcagacgagaaggtaacttgtgcaaggagtctcccccttatgaagccatcagatctcacgagacttaccactatcaagaaaacagcacgggaaagacctgcccccatgattcaattacctcccactgggccactcccagaacacgtgggaattcaagatgcaatttgggtggggacacagccaaaccatatcagtcaccaataaggaacacctacattggacttatacctgggctacatataaactattgttttaagctcctttctattttggcacttatgtgttaaagcagcaaggttgtttagctaattcagtgacacgagatcacactttgtttctgatgatttaaataagaattaatagaattcagttgcaccaggccatcaagactaatcatgcccttggaaagatataagagcagatgaataatttttctgtgtcacctcaaattctgtggtactacagcttatagccaagtgatatattctagttttattagtaaattgagtaaacattactatccaggaaaaaccagaaaaaaaaaaaaacaggaggcttataataaatatgacattttatctttgaaatataaaccagcttcatggaatagtcatctttaagttctaggacagtggcaaagtttttaaaagattgaacacatagtcatcaccaataaacccttacttagtacagactatgcatgaagtactaaggtaagtgacttctgtaagataaaaacatggaggaaacccttttgtggttcaggaacatgtattcccaaggttggtgtaactgaaggttagtttaagaatgggtacagaacacatggtgggaagcaataaaaggcaggcatagaaagccggattttgtttagaaagaacatggggttgtattaacaagagaatgacatgcttagacctgtcatcttcaaacactaattgtggtggcatgtgaacaatgatttaaagtaggaggaaattagagactggaagacaagctaagagagggaactgtaattatctgggcagcagttttgggggatcatccagcagagaatgtagaatttaaagtaaattcctctagtattgctattcggaatagaaaactacatttacaatgatttaatacaatatacattaataccaaaagtatagtaagaccttagatgtaaaatgtttacgtgttcttggagttccttttctatgcttgatgatcaattgatgtattaattttagtttttctaacctaaatgtatttgagggcgctaattttgaaagcaatataaatatgtcgattactttatgagttgcataaaattatatacattagtacaataccaaatgtacatttggagagggaatacagattctattagtaatttaatcattcatttatgtttttcattaaacatttaagttcctactgttttaggaccaggagatatagcagtgaataaaatgtacaaagtccttaacttatgaagcttaaattctaggactagaaataaaaataaggacaaataaatatgctacacaaaatcaggtcatggcaagtcctataaagaaaaatagagcaaggtaaagagagggaacaaaaggcatggagaggttggctctacttaagagaggatttagagagggaaagcctttcaactacaggaacatttaaaaatagagttgaatgaaataagcagttgaatcctgtgatgactctctggagaaaacacatttccatattaaaggatcagcaagtacaaaggtcctgaggcaggacctctctggcacttgactcccaatgagcctggatctgactagaagtgaaggcatggagagcctatgattagcgcatgcaatattaattttgattacaaagttactttaaactggattagctttatctccagtgaaacacttttcagagaccacagacaaatcttttggactacatctaaacattttttggaaggattaatatttctataattttgaagccatgtgaaaattaagatgagtctattctcatttagtgatcatgccagccttagaaagactgaaactgattaagtaaatgaaagtttgtcacacttaaggtgtaactactacagatgaaaacagaagccactacaaacctagcaaactaagtagatttctaaagttttcagcaagtgaaaacataaatgtcatctcatcattgacaaattccctaatcccattttgttaatacacacacacacacacacacactctgccactactccttctgtgccccaatacggcttttttcaaactactattatatcaagggctgtgattatgtctttgcaatattttcagtgtctcacccctgaaagatgcataacaacaattggttaaatataactaaatagtattccctgtgatgactctccaaaatatacgagtttctgtaccacttttgctatttcagaggttgactattttaatgctagagccagagacacagtaatccaagtgacatgctcaaactaaaagcactgatcaagaatgagaggattttgttttatctttgaggtttatacattattcttctcaaggatgggctcaacatctaagtatcttacatgttaaatgaaaccattccaagtcaaaaagataaaaataccaatatatttatatagagcactaggaggtcctaactaagccagtgattttgatactctgactatgccatagccaattcaaggagtaatagaaggaaacacctgaaaccggtacagaagaagatagaactagaagaatgggctgtcaatgcctaactgatgagggcattggttggccattcataatttgaaatggtaaatcactagctatttcctaaagcagatactgctgtaaaagtttctgatttctccctgaggtcatttaaacaggtctttgcttcatttttgaatgccgttattaattcatgacatattctactatatgcacttacatcccacaagatgaatctcctttggagggcctattggcccaactactaatataagtcattgttagtagaattctacatctccctttcctaaccttttctttctacgtttacaagggggaacagcaattgaattaaaataaacatcatttaaaaatcagcaatagcatgagttacaataactagtctttactctgtactatatgaagtatttaacatacattaacccatttattattaaccacattgcacaaatgaggaaactgacgaactaattgcttgtgtaaagtttttaaggtcacacatctggtaggtagcagagctaggattcaaagacagtgcagctcaagagcctatgctctttactcttacatagaggtagacgttttaaagggacaaaaatattctgagttgatcatttctccctatgtaagtgaactaatatatcactccctaatcaatccctgtatcctaaagagttaatataggatgtaatataggatgatctaagaactcggatacaacagactcccccctatatcaagcaagagtcccttatgccaagcataattacccgtgatggctaacataaaatcgtttggggaaaataaacatatcaaattgtttaagctcaagtagatttacagaaactcgggcaaactcatgtgttccaagataacaccacagactgtcacagcaactcatctggtaagctaattctgaccaatctgtcgagagcatacttagaaccatccagctcagcgtgtaaaactcttaagtatccttccgtcatgctcctcttctgagaggctatgactattccctgaaggtggtgcttaccctttccctgtaaatttaacaagctcagctttgggtgatcaacacctttgactggaggacattacaggtgtttctatggtattcattcataaactaaaagtagagctgactgaaagcctggtatttatagctagcgagagaaatgtccaattattagatgaggttcattttcgttaattattttagttattatgactacataatagttgtacatttggggtgcatgggatattttgatacatgaatacaacatgtaatgataaatcagggaaattagggcatccatcacctcaagcatttatcatttatgttagctaaattccaatttaactattattttgaaatataaattattggtaactataatcactctagggtgctaccaaacactagatctgattccttctatctaactatatactttttatttttttttttttttttacctatttaccactccctccttatcctgtcctccccacttacccttctcagcatctggtaaccatcatcccactctctatctccatgagttcaatttactttagctcccacatatgagtgagaacttgcaatatttgtgtctctgtgcctggttgatttcacttaacaatgtcctccagttttattttctattatttttctttctctcgctctccttttttaaagctcctctggagtgctctttcttagttttcaatactatattttctgaacatgttttttaaaatctacatctggcatctgatctattcctacaacctatccatattctgtctgacctatatttttatttatactttaattccatttgaatttctgctctgggctttagtttacacttgcaatgtgtgatatctgatatctggcccatcctggaacagaagaaatatatcattaccaatggaaaaacacattaaatgataggaacataggaaagtcggtttaagataaatgggcccctagaaagatacactcgcacaacagtatgtacattatataaagatgttaagattagggatgtctgaaattccttaggagaaatggcctgctaaagggcaagggttccacgattgtaatataagagagttattcaattttactaaaaataagttaaaatatttttaataacgtaatcaacatttaccaagtaccccttctttcaagtaatgggactaagaccggagggaaagaaacaattcgtaagatgcaacttctccattaaagctgtttaagtccacagtcaattacactgaaacactgattccaagagcatcttaagttaatctggatttattctttctaggtagttctatcacttagtatacttatgtattagtccattttcacactgccataaggaatacctgagactgggtaatttagaaagaaagaggtttaattgattcacagttccgcatggctggggaagcctcaggaaagttaaaatcatggtgaaaggcaaaggggaagcaagcactctcttcactaggtggcaggagggggcagggaacagccagacacttaaaccatcagaacttgtgagaactatcatgagtgcagcataggggaaccacccatcccccatcccccaaatgatccaatatcccaccagttccctcccttgacacgtggggattacaatttgagacaaaatttgggtgggtacacatagccaaaccatatcattctgctcccggcccctcccaagcctcatgtcatcacatttcaaaacacagtcatgccttcccaacagtctcgcaaagtcttaactcatttcggcattaagtcaaaattccaagtccaaagtttcatctgagacaaggcaagttctctctgcctacaagcctgtaaaaccaaaagcaagctagttacttccaaggtacaatgcaggtataagtattgggtaaatgtttccattctaaatgggggaaactggtcaaagcaaagtagacacaggtcccacgcaagtttgaaatgcagccaggcaatcgttaaatcttaaagctcccaaatctgccttgactccatgtctcatatccagggcaggctgatgcaaggggtgggctcccatgaccttggacagctccacgcctgtggctctgcagagcacagcccccatggctttcacagtgcctgcagcttttctaagtgcatggtgcaagttgtcagtggatctaccattctggggtctagatggtgggcctcttctcatggctccactaggcagtgccccagtgaggactctgtggtggggggaagggctccaaccccacatttcccccctgcattgccctagtagaggttctccatgaggactccgcccctgcagcagacttctacctgaacatccaggtgtttccatacatcctctagacatctaggcagaggttcccaaacctcatttcttgccttctgcacagccgtaggcagaacaccacatggaagctgccaaggcttggggcttgcaccctctgaagcaatggtgcaagatgtaccttggccccttttagccaaggctggagctgaagcagctaggacacaggaagccaggtcccaaggctgcacagagcagtggggccttgggcctggcccaccaaaccatttttcccttctaggcctctgggcctgtgatggaaggggctggcacaaaggtctctgacataccctgaagacgttttccccattgtcttggctactaacattctgcttctctttacttatgcaaatttctgcagcaggcttgacttactccctagaaaatgggtttttcttttctgccgcatggacaggctgcaaattttccaaacttttatgctctgctttccttttaaagaaaagttcccatttcagataatctctctgtgaacgcatataaccgtatgttttcagaaaaagtcaagtcacatcttgaatgccttgctgcttacagatttctgccagataccctaaatcatctctcaagttcaaagttccacagatgtctagggaaggggcaaaatgccaccaatctctttgctaaagcatagcaagagtcacttttactccagttcccaacaagttcctcatctccatctgagactatctcagcctggacttcattgtccgtatcactatcaacattgtggtcaaagccattcaacaagtctctgggaaattccaaactctccctcatctttctgtcttcttctgaccccccccccaaattgttccaacctctgccagttacccagttccaaagtcacttctataattgctatatttatagcaatgccccactatctgggcaccaattttctgttttagtctgttttcacactgttataaagagtacctgtggttgggtaatttataagtaaaagaggattaatagactcacagttctacatgggtggggaggcccccaggaaacttacaatcatggtggaaggtgaaggggaagcaagtaccttcttcacagggcagtggggtcggggggaaggctgtcaaatacttttaaaccatcagatcacatgagcattcacacactatcacaagaagagcatggggacaaccgcctccctgatccaatcacctcccaccaggaccctccctctacacgtggggattacaatttgagatgagacttgggtaggggacacagagccaaattatatcaacttattaatgcagaataaattgtttccaatacaatgagaaattttccctaagtttttctatttgtgacacctcaaaactaaaccactgatgttctcaaatgcttaattaattaaacaaactcatccaaccaaaaatatgcttgtgcatgaaagctgatgttttatggttacaaaaagtaaaacaaaatagtatgaaataaggaaaacatactgcattctatgcactgataaaatgaatgaagctaaatgggtcataaaaaagtatatccagttttatagggcgtgaggcctatatagcagcataaatttgtcttttttttttgtttttacagtaattaagagtatgcaacacgctccacaattatctgagtaattagattttctcaattaaaaacgagcactgataagattagctggatttctaggtcactttgtttcgcagcattatcaatttatccaggtcagaatcttacatctagggatacagactggactggaagttcctagtttttaagtttggtttctggttggggggggaatcctaccaagctaggaaattaatgggaggatgcaattgaaataactaggatagtacttaatgtgttgtaaataataatggcagttattactttgtaaaaacatattttaagcaagtatggaatttctcagaaaacttaacctcaaagcaaaaattttaagattgtttatggtaagaatttaatatcattttccatgtattctcattcttactgttattatttcagtcattggggaaagttatgcttccttcagatggggtgattagaataaacaagaataagacctctgaattcaggacttcgcagttttccaaaagaaatcggtattttttaaacttttaacagattactcctttctattgagcaaatctttacctttccaattggtatttagacatgtaaatttaaaacaaagacattcttctgcaaggaaatttcagatgcttccataagcatttgaaacagcccaactgtttttgcatacttaaggaaagagctatcttaaggatggcaacagttactgtgtaaaaattttagaaatccttttaagtatcaagtatacattcttatgccctgtgcacatcgctgctcaattttggatgtccagcagtgtgcgcacgtccatgtgtgcatgcacataattatatacccatgcacatgagcacattcatttaaccatacaagaagcaatcccagcaagaattctaaaaaactgatatatgtctgaatattactggaaaagagactgtaggtgagacctgggcttcatatggttcaacatagatttgtcagttgatgctgttaattaaaaataatacagaatatataggacaaagtattgtgtgttgatgtaattgtcccatgactgtgccaggtaagaagcgtagaggataatattccctgaaaacagtagggatttctactgctaaacatcttttaaaatgtcagatcctcgcaaaaaaaaaaaaaaaaaatatggactttcgtctagggtgagggaaaaagtttttcccttcgtgccttttgtgattcaagtcccgaaccctatagaaatgagcactgctggacttctaccattgagggcagtttgtcaggccccaaagctgaacagccaagtacaacagaccagagctaagaaactgaacagaaaaaaaactacagagagtgcagtagtattcaattactgttgtaacatattcccaaaatcttaatggcttaaaacaagacaaatgttttatcttacagctgagtaggttagacatctgacatgagtcttattagactaaactcaagcaacagcagggctttgttcctttctggaaattctagaagagatcatgtttctttcccttttctagcttttatagacctccaatattccttaacccctggtcttcctccattcttcaaagcgaacaacagtaggtatagtctttctcaaattatatcactcaggcctactcttgtgcctctttcatttttaagcattccggtgactacatagtgtgcactcaggtaatccaggttaatctccctccctattttaagatcagctaattaacaaccttaattcccctgtgtcatgtatcatgtactatactcacaggttctagggatttcgacatgagtatccttggggagccagcatccaactaccaaaggagagtttaaatatgcaggtttaaacaaaaaagtcgtatcatattgagtatccagatttcactttgtctccgatatactctaattctggtattcccaagtattaaatatcttgggcaccaattatttttgtaaactggtgcctgtaataaatttgactaaattaagctgattatttaagctaattgttcatgtatgaattatttcatcattccactgataggtggcacagtagctcacacaattccaagagatttagtttcaaatgaaagtcgtcctattcatcccctttattattgattttactgcacacacacagagagtcattactagatgggaactgataacaatgttgctcggacacacaatgacacctaatatttatattaatatgctagcacattttttctgttcctattttttgatagctgcaaattagtcttttgtcgcacattccctttttcatgaggtttttaaaatgtttaataaatcatctacatatttaatttttaccactagcatttagacatttttaaagttatcttttgaaactaaattatttttagattttacagatgttcccccttcctgtgtccatgtgttctcattgttcaattcccacctatgagtgagaacatgcggtgtttggttttttatccttgcgatagtttgctgagaatgatggtttccagcttcatccatgtccctacaaaggacatgaactcatccttttttatggctgcatacggcctgtggtggggtggggtggggtggggtgggggtatgggggagggatagcattaggagatatacctaatgttaaatgacgagctaatgggtgcagcacaccaacatggcacatgtatacatatgtaacaaacctgcacgttatgcacatgtaccctaaaagtataataaaaaaatcaaaaaaagaaaaattttaaagattactattcaagatattcttgggaaaatatttaaattataataatcccaatttaaattatactttaattatgtggtcattttatattttaacttgtcatgtatcttctcccatacaagcctgatataaattttacatagaaatcatgatctgtgtatccatatacttctcccctcatagtacacacacttacccgatatgtagtgtgtattgctttagcatactcaataaaatccattgagacaaaatatgccttatgtttctaattgtaacagtcaatttttaccatataaattaccaagaggatttttctaaaattatacgatgaatgtagcaattacacaatctctctacaacttttgtaccatacatggaattctatactagaagccgacattcttatgcccgacagaactatttagttcattttatgagacgtgctattgagttttagataaagtttgaaattttataacagcttattctgtaagaatgcatacaattatcaattaccttgggaataaattgttttacatatttctgagaaccttctgcagcttcttgtatatcaaaccacaggtatatgttttagcatagttaatattttttgaaattaccttcaccactgttattttatttaaataaaggtaatcaggaaggcctttcttcagcttagacaacaaagtagccagtaagatcaaggaaaatattaggtaaaacccaaatacaacttcaatacttggatactgaccatttcattgcttgttaatgttaattccttggattaatcagttaatttaatctatcagcttgataacgtatctgatcagaactttaaaatcctaactggtcttcacacatattaatgaccctcacactttcatgtaatatgctaatgtaaaagccgtgtcttcaagaaacatttgttgtacattaaaaaacaggcactcgcactttcagaggccgaggcgggcagatcacgaggtcaggagatcgagaccatcctggctaacacagtgaaaccccgtctctactaaaaataaaaaaaaaataaaaaaaaataaaaaataaaaaaattagccgggcatggtggcaggcgcctgtagtcccagctactcgggaggctgaggcaggagaatagcgtgaacccgggaggcggagcttgcagtgagccgagatcgcgccactgcactccagcctgggcgacggagcgagcctctgtctcaaaaaaagaaaaaaaaaaaaaaaaaaggcactcttatgctctgggaattcagctgtgaataataaaggtcccagcacatgaggaagtcaccaccaataacaggactgaacaagtctacaactacctacagcattgtgataggccagcagtactatggtgggaacaaactccactggaacattaagtgagaattattttttgaaggttaggaattttacgttggattaaatatcaatgatacaatcaaagtgaaacatgagaaggactcatactgttgtttactctgttaatattgtactaaacagtattgaataaaacaaaatcaacgaaacatttgaaaaacagaagacattgtatctttaaactagtgatgtcattttcttgcattctcatatataactcaatataccgggaacactgtagattctaaataagtattatgtaattaagtaaataaattctcccttgcctctactccagtaatccctcttcccttgctgctgcttgtgaatgtgtcagcctctctcctgcaaccaaatttctaccccagacatactacattcgtcttattccatctctccatgtattgacaagatgggcacatgagtacgtgcacacacatacatccgcatactaaggcaaagtagcttactttacctatctcagagagaaaactagcctaaacataaggaagaatgctcactaaagattttaagatacagataaagaacatttgagtcacctttaagagacataaattacatgttcactccactttctctctatttccccaaatatatggtattctcctcaaactaagatagcaagatatctcagttgatatcttaatacactcagtattcatgtaggctcccaggtaagaaaaaaattattattgttgcttgtctaatcctagttgcatttaaatatgaaatagtaacatggtaattttttagaataaaaaccaattttgaatacaatctaatgaaaactttgaaaaatgttcatttccaaagataaattaaagacagataatttcacagatcatgctctcccttaacattaaaaaggttcttttctcatatatgtattaaatattatcattaaaaatcactagaatatcaaaaaaacagcctacagacttggtgtgtatagtatgtgataacataagcacaaaacaaaacaaaaaactaagaatagtttcaatatgtatgcagtaacagagacacatgctattctgagaagggttaaatcaacaaaggacataatctttctggggttcagctgtgaaatgcagagtggaagaacaacatcccagggagttggaacagcaagtgctaaggccttaaactatgtaaatatcatgctagatgattgtgtgtaaaagagaattaagttaaatccagaaagaaaatagggccagtcattgtcaagttcttcctgcagtcacagaaaaagatgagaataacttgaactatggtggtggttgtacaggtggagaggtatgaatgatttagtgatatacagtgggccctccgtatctgcgggttctgtatctgcaaattcaaataacctctgatttgatacaatagggtgaatatagtcaataattgtgcatttgaaaataacttcaagagtgtaattagtttataactcaaaggataaatgcttgaggtgacatgctattctcatgacgtgcttattccatattgtatgcctctatcaaaacatctcacgtaccatatatatatacacacacacgtatatatatacatatacacatatatatcatatatacacaaacaccccatgtacccacaaaaattatatacacacacacatacacacacacatatatatacctatatggtgtgtgtatatatacacacacacgtatatatacatatatggtgtgtttatatatatacacacacatatacatatatggtgtatatatacacacacatatacatatatggtgtatatatacacacacaccatatgtatatacatatatgtatatatatataccatatatatagatatatggcatatacacacatatataccatatatgtatacatatacacatatgtgtatatacgtgtatacgtatatacacatatgtgtatatacgtatatacacatatatggtatatatacaccatatatacacacatatatgtacacatatatggtatatatatacacacatatatatacacatatatggtatatatatacacacatatatatacacatatataccatatatatacacacacacccctagtatgtacccacaaaaatttccaaaaaaaataaattgtttcccaaataaaaaaatattcaggaaatacaataaaaattaacaggatagaaatctccctgttgggtactatgcttattacctgggtgacaaagtaatctgtactcagagcccctgtaacacataatttatctatataacaaaaatgcatgtgtaaccctgaacctagaaattaaacacaaagaataaaatgtaacaactatttacgtactatttatattgtattaggtattataagtaatctagagataatttaatgtaaacaggaggatgtgcataggttatatgcaaatatgacatcatttatataaggaacttaagcatccacagattttagtatctggagttcctagaaccagttctcagatagtgaggcacagtcgtattcttaaagtataatctataaggcatcatggattgaaatagttctaatacttcacttttttcatacttaaagctgcttaaatgaccaacttaaaagatagatttattattacagagatttcccgatccaagctattaatgtcagtgcagacatggttgattcatggagcgggggtgggggggggaaatacacacctggaactcatctgtgtgtttagaggacaaattaaatcatttttaaatagccccaggatgatctcagccattaaagagcagaaggctaataaaacaactgttcctattaaatcgttttctgagttttataagtagatgtcctcccttatgtattttattggcaatatatgttacctttatagagaagcagcgtttctatagctctcaaaaaggttaagaacccgaggtgtattataggccaatttctcttgtaaatgttgacttaaaatagtttaaagagcattttctcatgttggaggtgattaattgcactgagtttcacttgtaaaaatccattgctcaaacctaaggatggtggggggacacccatctgtgcaaacgtgtggacttacaatgacttttgcttatgttagctcaggtgtcagttctaatgaacaactttcaacaagagaaaataaatccagaactttttattagaaatcacacatgttaaacagaaatcattaactaaaccttactcaaaatagtggtggactttatcacttaagaaatcaattaacttccaaggaactatagaaaaagttaggttcccgctccaaaatcatcttatcgatttatgcatttatgtccaactaataaaattagggaagcagagtaagaactactgtatggatccgtggattttggtatatttaaaatcccatataagaattatgatgcagccacattttcatttgacataaatatttgtacatttattagaatgaaaaacatgctctgtactttaaaaaatattctctgaattagttcacattctgtcttatataacagttacctatatattgtttgttggcctatatgcaattttcaataccttggcagactgtatatcttttacttcctgacacacttggagtatatagcactattccttatgtaaagttatcaatagacatttgatgaattaacatgcatttctactgaacaaagtaagcctggggcacataactttaaaatgcttatgtagcatctgaaagaatttacaatgtcagactaagaataaaaagtaggggctccagaatttctactttattaatgatgtggtcaaatcaacccattggaaaaaatcttagtctactcagccacctgcacaaatgctcgtgctctataaaagcattaaaaaaaaaaaaccttttagactagtctatatgtactctgcagagtaaaagacacattagctaaaacaatagtgctcataatattaatgtatttggcttgtgtaagtaacaatatttaagctctgacaataattctaattttaaacattttcattccatctgcaagattaaagtttgaattattatgattattcaatgcctcttgatcaatctgaggaaagatttctttcaataagaacattccttcaagcactacctttgctatgttcttcactagtctatgttaagattaacgtgaagaaggctaggtaaggagtattatcatttctattataatgattttgcttaaaatgtacatttctgtttatgatgaatgcaaagatattatcatttaatggaaaatttatgtaagacagatctcgctacaactagctttagcagttttacttaggttataacaatttaaaaatttctcatcttatagtcccttaatattccatattttttaacttttttcgtatttcacatgcagtttgttggtgaaagcaaaattcgagatataatagagagaaaaaaatacattatttatttttatccaggagcttatgtctcatttttatatcgttgttatattttgcaatgggtgaaatttgtctttctcttcagtcttttaaaacctagttacttcaccaggttttttccaaatactcaaatgcccaatcgttatttttctatactagttttttccccacttctggctgtctcttttcagagtccctttgattaacaactacaacaatatcatagtctgctgtttaactacagtgaggtgaatttattaagggcttcaccatgtactcttgcctcttgaggaggaataagagtgtgtgtgtgtgtgtgtgtgtgtgtgtgtgtgtgtattccaattattaataaaaacagttttcaaatcacttttccaagagactcacttgcccaactgattctatacagaaaaacttagatattaaagcctaggtaaaatgtatctttttatttagactttctcagataatagcttttttttttaatccacatatgactcaaggtgggatttcaatctagataagagatgttcacatcacgacctcactgaggaaatatttgagatagtgagatgttttgatgcctttgccatctaattttagagttaactgagaaagagtagaggggaatattttcataactggtgagtgtctccctttgataactttagtgtggcttggatagaatgtcatacttgcaagatttgtaaacatccttctactttaattatttaatgattctctcaaggaaacatcatagtaaaaagaattcagtatccctcttattctggctctagtttataaaacttttccatttattttcaaaacatttggaatcaactgatggatgtgcatccaattaaaaacaaacccaattagccctgtaataaaatgagtaaccttttagttaatgcaaagaaaatattcatggaagaagagaggaatattctgccataagattatattctgtagtagttacaagtagggaatcttaactccaactcactagctgagtgatgtgggcaatttacataaactcttcagttgcaaatgaccaaaataatagtctctacctcctagagtttttgcagaaataaaacgaaattatacaatatcaagcaatgtgcccagcacttaatgtttaataaatatcacaccagattacatcaatattactatgtatgtattactcccagcttcagaagttgagtttttctgagagtctgggaaccaattcaaccacttttacgatgtcatatgacgtaatgactacaagagaaaacctagttatacttttgcaagtgtgctaactaatgtcttacaaatactatgacaattataaggtactatcatgaaccagccttcaggagacttgctagaaatctaccatgtatccatgacaactgtgaatcaatctctctgtcaagtgtgtgtgtgtgtgtgtgtgtgtgtgtgtgtgtgagagagagagagagagagagagagaaagagagagagaaccactctgaggaatttaagatatagtataaatcttttatgaaaactagattagactctggagctcaaggatatcaaagattaccacccagtacaccagctgtgagccagcagtattcctcagaccagaaaaccagaatgagtgggaaggtcacaggaagaccagcaagatttcaaatgggaaatgacagtagatcccccttttccacgggggatatgttccaagacctacagcagatgtctgaaaccacaaataggccctatatatactgtttttcccatacatatacatacctatgataaaatttaacttataaattaggcacagaaaaagattaataactaatagaacaattatagcaatatgcagtaataaaagttacgtgaatgtggactctcacctctccctgcccaccctccccaccatcatctaattgtactgtactcatcaatttaaggaccacggttgaccatgggtagcagaaactgtaatgaataagggaggactcctgtatttaatttggggagagtcagcatttattctagaggcaggcaaaataactggaaagatcagttttccctacaggagtataaagggaccatttaatttttacaacattccagttatttgacataactttagctactgtttctgggctcatattacgggccaaatacatacaggttttacttactccttgaagtagcagtgggaggtaaatatttttactttacacgtgagcaatactgagcctcaataattttccagtggcctaaaactaataaaggcaaaaatcagattttaacccaaaactagttggctctgtgtagaaaaagttaaatcaaccctaggttaatctgatgctgcctaggaaaatgaacatagaaacttattttcttaggattaagagttaagataatagtagaatttcttgtcactcttgtttgctaggtaggactactattaaattaactggggagtggggcagagaggcaatatatagtcttttgtcctatgtgacaacaatggtattaaatattggtgggaaattaatgctgcaatttcttcatgtcaagtaaaccacactgattttggccgttgtcctagcagctatatggagcacatttgggtgagaggcatgtggaaatctgtatgttggttgcttctgggccatccaatgatacaaagattctatgacagtgtatctcctgccttgtatccttctgtacagctaagtaaatgtcatagattaaattctattccatctgtgagtataattgccaattttatctccttacaactacactaacagtgcaggctccaaagttcattatgtcctgtcagtaaaagttgcatatctggctaaaatacaaactgtttagcaaaactaaccctggataaatggtaaataaattcaacctatttatggcattaatatcagagatcataaaattaagccatttgcttatttcaagtggatttatgggatcagacttctaatttgaaaactattattttaccatcattttaattgttttcccttattagcccttagttattattaaaaattcttctagttctttatcagctctgccaatgaaagacatttttattggctgcaaaaggcatcaacaaacctcagatagcagaacacagtgatgtcaattagtaacaagatgagagaggcaggcaaaagaagaaataaattaaagaacaaagagtcagggatcacctctgcaaacagctcctctcacctgggcaacccttgctggaaactgtttgagtcagagtaccattctatcacaaacatgtccgtgaagcaataaatagaagaaggaatgaagagagacaactgtgcagacaggagataaggcaagtttcttaatcctaaagagaatgttttgatggccagtcttatgtgacagctagtctatttttactttgtctgtggatgaacaatttctcattaacagaactgttagcaataagcagtactccagtaattgaagatgtgaacagcaggcttagtcattttttaaggaagaaaatgctagaagtctaaacaaatgctgggacaacagattctggatcttatcctataaaagggcatatctcacagaaacaattgttccattgtagttgtttctatcttagctgcaggatactctcacttactgagcttctaaaaattgctgatgtcacagcccgtcctcagtgaaataaaatactagtttcaatcccagtgttgccataaagcttccccaaccgattttattggacagtcttgtgagaaataacacggactttaagaagagataaaccctggatttgattatagctcagttatctattggctgtgtgatcttgattttaataaagctctctaagcctcagtttttccatttataaaagaaggataaacttacctggaattgttgtgtacaagacataagataaagtatggaaattatctagaacatgactgccctacttaaacatttgcactcttctaccaaaaggaacttgcaaatttgagtttatatcactgatgataaattagaaaaatctttgcaggggaaaaatgtgctttgatttgaagcaaaagtttattcagcaatattaacatctcacaagaatgatattacaggatatttcctaaaagtaaaaacactggtttcaaccaccttattaaattgtaataatatataaaattcctaataatttaatagttgtaacagttttctcacttttcaactggatatcatatgatccactaactccacacgattgccataagacaaaaaatctggggcttcaaaatggctgaattgatggatctgttactcacctcttccatggagaggaaccaaagtaccaagtagataatcatactttgaatacattaactaagagaaaacactgaaattcaacagagaagcaatgaaaaccactaaaaggaaaaagaaggaaatgaggcactctatccagctgagattggctaggagtctggagaggctccctaacatggggagagaattagagatgcacaaaggtacacattcttgtacaagattcctacaatcctagccaattgagagcccttcaacccgtgtgggcccccaaaccaacacacagctgtctagatactgtgcaaaggcattgcttcacggaagaagcccatgctgggttccacaaactctagagtcctaagcagctgcaacatggcctggttttgagagcccagcccccaccagtctatgtcctgacctaggactaaaaatcttccctatctccacattcctggagtctcagtgatatttcccacccatggctgcaactgctggggccaaggcaggaaccactggcagcaaaccctcccctgcccaacagaggggtggccactcaacttcatgcacactgaagactaattccactgcctgcaaatgctgtcactgtgaactgctgtggagttgagacacaagcgacgcacaggctacccaggcaactgcttatggctgctcccaaggaaagcaaccttaccctctccagtagcagggccacagtgtagccaacactgccttccacctgagcattgcacaagggacctggggagcaccttgcccctcgactacaataaccagtggttgcatgcaccaccaggagtcctgaggacaggtcttcccagctctgctcttccaaatcccccagtacataaaaatttgtatagagacctggggctctcccaccccagtttaccaccattggcatctgactagtcttcctggggcctgaatttgggcccactcaagcttccactaccaccaaagctggcgtcaacctacatgcaccatctgcaggcctaggaactggcttgcccaatctgttgcatccaccaccaacaccatcatggattgcttgcattccagagggttgcccccctcccactattgccattacccgcaccatgcttgctgcccctgggctgggaacctgtgtacccacccagcccacctatgcttttcctgacaaccaagcaagccacctataagccaaagggttagcctgcctggacacactaacatcaatgccaatgtacacagctctgaggcctgaggacaggcacgctcaaccaactgatgccaccactggggcctgaagactggaccacttggtgtcccagtcaccggcaaaacttcaccacagcttctgctaacaactgcaccctaagctactgaggaagttacagacaccattcatactgtttacatccaaagaaatcatacaggaagtatactactatatacattcagaatcaaaggcaaagactcaagaggagactagataaaacagaagaatctcagaacatgaaaacaggtcttttaaaataacctactcaaacaaaaaataacaaaaaattttaaaaaaatgagcaaagcctatgtgacatatacaacaccataaagccatgaaatgcttgcattttttatgtcctagaaggtaaaggagaaactaaaggtttagaaaccctatttaacaaaataatagatgaaatcttcccaagtctagcaagagatttagacatccagatacaggatgctgaaagatctcaaaaagggatacaattcaaaaatgtcttgtccatgacacattatagccaaactctcaaaagccaaagacaaaaagagaattctaaaaacagcaagagaaaagcaccttgtcacttataaagaaacctccatcagattaacagtgaatttctcagaagaaaccttacaggccagagaagaatgagatgttatattaaacttgctgaaagaaaacaaccaccagccaaggatactctacccagccaaggtagccttcataaatcaaggagaaataaaatagttcctagacgagtgaaagctgtggaaatttatcaccatgatactggccttacaagaaaggtttaagggagtcctatacctggaagtgaaagaatgacaactaccatcatgaaaacacataaaaatataaaaacaactagtagtgcaaacacacaaaaaaaatcaagaaaagttactcaaatgttaccactaaagaataccatcacactataatgataatgagggaaaaaaatgaagaaaaaatattcaaaacaaccataaatcaataaaatgaaagaaataagccctcacatatcagtaataatgttgaatgtaaattgattaaacattccacataaaagacataaactggctgaatggattaaaaaatatataacccaaaaatattctgcctaaaataaactcatttcacctgtaaagacacatatagatttgaagtaaagggatggaaaagtatattttatgcaaaccgaagccaaaggggagaagcagcagctatgcttacataaaacagactttcagtcaaaaacagtaaaaacaaacaataaggtcattatataatgataaagggataagtttagcaagagtatataaaaattctaaacatacatacacccaacacgagagctcccagatatataaagcaagtattagatctaaagggagagctagatgcaaatacagtaatatctgaggacttcaacaccccactctcagcattagatcacttagacaaaaaattaacaaagaaacattggcttgaaactgctccttagaccaaatagtcctaacagacacttataggacaattccttcaacagtcatacacatttttttctcataagcacacagaacattctccaggacagaccatatgttatgacagaatatgtcttaacaaatttataaaaaatcaaaatcatatctaatatcttcttaaaacacaaggaaataacaaaaagagaaactttggaacctgtacaaaaacatggaaattgaacaacatactcctgaatgaccattgggtcaaggaagaaaattgaggaaatgttttcaaaaaattattgaaacaaatgaatatcaaaatataataacacctacgggatatggcaaaagcagtgctaagggggatgtatatagcaaaaatgctcacatcaaaaatgttgaaatatttcaaacaatctaacaaagtacttcaaggagctagtcaaagaaaaaaaaacaaaccaaacccagaattagtagaaggatgaaaatcctaaaaattgagcaaaactcaagaaaatagagagcaaaaaatacaaagtatcaatgaaatgagaagtttgatttttaaaaagatgaaaataaagcacttgctagactaaccaagaaaaaaaaaagactcaaaatcataaatgaagacggagacattacaactgataccatagaaataaaaagttcagagactatactgaacaactattaaataataaactaaaaatctagaggaatgtataaattcccggacacatacaaccaaccgtggatcaagaagaaatagaaaatctgaacagatctataattagtaatgatcttgaatcagtaatcttaaaaaatttcccaacgaagacagtccaggaccagatgtctttactgctgaattctaccaaactttaccaattctcctgtaagtgttccaagaaaaattgaagaggaaggaattccccctatctcattctatgaagccagcattaccctgatgccaaacccagacaattatgcaacaaaaaatacaggacaacatccctgatgaacactgatgtagaaattctctacaaaatgctagcaatccaatagaacataaaaaatgtaatattatcaagtggaatttatcccaatgatacaaggatacatcatacacaaatcaataaatatgacatattacatcaaacagaatgaaaaacagaaaacatgatcctttcaatagacacaaaagaacatttcataaaatttaacatcccttcgagataaaaactccaacaaactaggcatacaaaaaaaattaacaaaataaagaccatatatgacaaatctacaagtagtatcaaactgaatggggaaaagctgaaaaatttctccctataaaactggaatggtcaggcgtggtggctcacgcctgtaatcccagcactttgggaggcagaggtgggtggatcaatagatcaggagatcgagatcatcctggctaacacggtgaaaccccatctctactaaaaatacaaaaaattagccgggcatggtggcagatgcctgtggtcccagctgctcgggaggctgaggcaagagaacggcatgaaccctggaggctgagcttgcaatgagccaagattgggccactgtactccagcctgggcaacagagcaagactccatctcaaaaacaaaaaaccaaaaacaaaaaaaagaacaagacaaggatgcccactttcaccactcattcaacatagtactggaggtcctagccagagcaatcaagagaaagaaatacaaggcgtcctaatagaagaaatcgttgtccaagtactgctctttgttaataacttatagctagaaaaagctaaaccctcaccagaaagctctcagatctgataaataaatttagtaaagttgcaggatacaaaaatcaacatacacaattcagtagcatttctatataccaataatgaactggctgagaaagaaatcaagaaggcaaacctatttacaacggctggaaataatacctaggagtaagtttagcccaggagggaaaggtccgtataaaatacagaacactgacaaaacaaattgaagagtacaccaacaaatggaaagtcatcccatgtttatcggtcagaagaattaatgttattaacatgatctttctactcaaagcattctacattgaataatgcagtccctatcagaatacagaaatggaataaaaagtgatcataaaatttgtacgatcaaagaccagcagagagcctgaatagccaaagcaatcctgagcaaaaagaacaaagacttatgaatcacactacttgacaaaacagcaaggtgttagaataaaaacagacatatagaacaatggaatagattagagaactcagaattaaatccatgtatttacatacaacttgtttttgacaaaagcaccaagaacatgcattagggggaaggacaccttcttcaaatggtgctgagaattggattgtcagatgcagaagtatgaaactggatccctgtctctcaccatattagaaaattcagctcaagatggattaaggatttaaaggtaagacctaaaactgaaactacatgaagcaaacatagggaaaacagacaggaccttggtctaggcaaagattttatggttatgacctcaaaagcgcaggcaacaaaaacataaatagataattgggactgtagaaaatgaaagagcttctgtaaaacaaaggaaggattcaacagagtgaagagacaacctgctgaatgggagaaaagatttgtaaactattcagacaagagactaatatctaggaaatacgaggatcccaaacaatttaacagtaaaaaaataatcacattaaaaatggacaaaggacaataataagtatttctcaaaagaagacaaatgaccaacgggtatatgaaaaaatgctcaacatcactaatcattagggaaatgcaaatcaagtcatgatgagccatcatcttgccccagttagaatggctattattaaaaagacaagaaaacaacagatgttgacgaggtgcaacgaaaagggaactcttaatacattgttgtagttcagaatataagtcagtatagccactattgaaaacagtatggagaagatttctcaaaaaactaaacatagaaatagagtatgtgtcagcaatgccactaataagtatatatgtaaagggaaagcaatcatatacttttctaactatcaggaaaagtatatgcatggcatacctgtacttgcatgcttattgaggcactatttataatagcaacttaagtgtccattagtgaacaaatggataaagaaaatgtggtacatatatacagtggaatactcttcatccataaaaaagaattacattttctgcaccaacatgaatgaaactgcaggttattaagtgagacaatcgaggcaaagataaatagattttacattttcttactcatatataggtgtaaaaaaagttgttctcatggaaatagagagtataataagataccagaggctaggaagggtaggaagggaatataaaaaggggttatttaatgggtacaaatatatagttggaaggtatatattctaatgttcaacagcagaaaggggtgactagagttagcaacaatatgatgtacatttcaaagtagatgagagaactcaaaatgttcacagaacataaaaatgataaatactcaaagtaatgaataccccaaatacactgacttgaccattacacattcagtgcgtttaacaaaatatcacatgtatgtacatatatgtaaaacgttatgcatcaataaaaataaaagttctaaaaagagaataaatctaagaggatagcttattgctttaaaataaaatgacaagacaactataaatcttcaggtttccctctgcaaggaataaatcctattgtatgacaattaaatttccctcttataagatttaaatgacatcaacaaagactttagttcatcattattttacccaaatattgttgtaaaatagtatattttcatcttatatttcatgttccagctgtaaaatgtcacatgcattttatatatagaaattatttaattggaaaacatatgtaccaacctaatatctatttttccagtgcccagctttaaggtttttggatattcatttgcaggttctgtgatgtctttttttgtttgtttttgtgggatggggggacagggcctcagttcttttgcctaggcttgagagtagtggcacaatcatagctcaccgcagccttgaactcctggcctaaagcaattctcctgccttggcctcccaatgtgctgggattacaggtgtcagccatcacacccagccctgtgatatcacttataattatgtataaaacacagttaactccattttgaagacagtgaagtaagttttccaactatcagcaaaatatacattacattcaaatattatcactgacttaaaaccacatagaaaattttaaactacttatgccattttattctcatttaccatcattagaatggtcaaaatgtttttgccaaggcaaaattctgtgacaagaaacacagatatcaactatagaacacttttctgaatcaaacctaatatctcatgtattccttcatagctgaaataaaattaacaaataccaatagatgtttttaatatatttctttagtctcatgaactcattgtgatgatatgactaggaaaaccatccacaaagtgtctattacatattatttagcattagaacctcatggctgcatttctcattattaatttattaatgtcttgtcaatcattcaaaaatcacttaatgtcactgtataggccaaggatattgttatttcacctgtaattaaaaaaaaaaagttgtgaaaataatcctggtaagctaattgaaaagagattctcagttatctaggtaagaattatatttaaatgtttctgaacaaatttggcatagaacctaatccataatgcacatcttcaatcgcatgattatacttcattatttaaattccccaactgagtaagaaactcttacttaactaaagcatactttaacaaatcagcccctaggggagatagaaattataaattgaccattttccataaagttaaaatggtgacaaatcatagaagaatgtgaaagattagtagaaaataccaaaatttgttataaagggtaaattcaagccaggctcccgcacacacaaatatcatatttaatgtttttcaagtctctgttgtctaagtaggtgaatttgggacagttacatgcaattatttgtcatccaaacaactgaaatggataaggagaacaaaaattgctttcatttattagtgactggttccaactgcccagaaaatactcagtttttttatggtatctgaactgagaaagatgtacaacacataacatcaagagaacacactggaatactctcatgcctcttctaacttttaggccactgggaaataacatttacgtcttaatttttgtcatgaagagcaatttcaagatttcccatcagggaagaggaaattgctacaataatatctgaatgttaatataatcatctgtatcatacctatttggtatatattactttgtcatcaaaaaggcaatggccatttttcattcatgtaagtgccagtgaaatattttcttaaatattttcttaaatatattttcaactgcagagtttgactctaaattgtctgaaatatttacagtaaggatttctagttgaaataccgtatatagagaaggaacacctataatattgcaatcgcattagattttctgaaaacaaggtactctataatgagttctagacaaaaatcaatctaaatgatataaaattagtgtttatgttcacaaaaatatttatttatttaaattaactctaatcctcctgagaattaaccctctcaattttaacctgtgtaaacttataaacatttcttgccattatggtatcaaaatgtgatgattacagcagaggcggaaaaaagttaaaacagcccttgttcagccaattgatatcaaacccaacataagaggccttaaaaatattcttctcttttatagcaaattctatgtatctttccatgattatttttgtaggttaaaatcctgcatgcatacaaagccaagtctgaaagcattcactccaggagtaaaactttccaacaggcagagctaattcttggaaaagaaggctataaaaacaactcaagagtgatgcagggattagccaagcagaaaatagaatccgtgtcaccattctcaggaagtcaaaataaaggggattaaaaccaaaccctaacgggtttgtaaatgtcattttgaggatacaaaaatttctctcgagtcctagtgtccttccttttttggtcaaatttgactgtcattattcatttttgttctaaagttaccctggtaaataagtaagaacatttccatatcatatttcatatcctaaatggaaatggctttctacactaatattcaaaagacatctagaacaggcgcaatcttttatccctgattttttgttttattcctttaaagagaacatcctcactttgttattcacaggggaaagctgacaaagcactctcttaatatagggaggattttttttttttttttggactggcaaacaaaccaatctgtttgaaactcagagaaacaatgtatatgaaacccacgaccaacgcatgtagaatgtactgtcttacagagaaatcataacgggaagagaattgtctgattcacaaaaggatatttttaaagagatatacctattatctatgagcataaacatacataatttattaagtttaccctagatgtacttatttttgcatatgttagcatctaaacacactagaaacagctcctgaaatcgcttatgctaatgcctactgctactcattttaaaaggcaattccacttaaaactaaacctcaggcctcaaaacaccagttaaggccaaagcatatcaaattctatatatgaaatcctacaaggtttcaatgacttcctaattttataaagcaattctatcaacaaagcttatgtttaaaattgtcaaagcattatttggcaggtatttcttaaaccaaatatagcttcaatcccccaataataaaattctccccaaatgtttcattattctcctaaggggcataactaatttaaaatgaaatttctttggagagtagccaacatcatgcataagctacagaaccaatatctggttaaataaaaatatgaacatcacaaaagcaattactatacaggcatgaatcacgaattttgctggtaaatctatcgaagagagtgttctaagtctgagacttcaagagatggtgttctgtcttttgtgactaagcagtcagtaaataaaaattcttatgagttattatttttttctttgaatcatcattgagattatctcctgaaaaatgctgagcaaaaatgtataaatgtgtacttggtggtttccctaacacaatggcaagaattgacatattttaaaaatatatgacttatgctgaatcctcatcttatttgcagccataagtaaactttaagaaactttttattattatactttaagttttgggatacatgtgcagaacgtgcaggtttgttacataggtatacacatgccatggtggtttgctgtaccaatccgtcatctatgttaggtatttcccctaatgctatcactcccctagccccacacaccccaaaaggccccagtgtgtgatgctccactgcatccatgtcttctggttgttcaactccgatttatgagtgagaacatgccgagtttgattttctgttcctatgttagtttgctgagaatgatgttttccagcttcatccacatccctgcaaaggacatgaaactcatccttttttgttgctgcatagtattccatggtgtatatgtgccaaattttctttatccagtctatcattgatgggcatttgggttggtttcaagtctttgctattgtgaatagtgctgaaataagcacagaataatttataatcctttgggtatatacccagtgatgggattgcttggtcaaatggtatttctggctctagatccttgagcaatcaccacactgtcttccacaatgtttgaactaatttacactcccaacagtgtaaaatcattcctatttctccatattctctccagcatctgttgtttcctgactttttgatgatcaccattctaactagcatgagatggtatctcattgtggttttgattttcatttctctaatgaccagtgatgatgaacttttttttcacatacttgttggccacataaatgtcttctttgagaagggtctgttcataccctttgcctactttttgatggggttattttcctgtaaatttgtttcttgtagattctggatattagccctttgtcagatagatagattgcaaaaattttctcccatcctataggctgcctgttcactctgatgatagttttcttttgctgtgcaggagctatttagtaagatctcatttgtcaattttggcttttcttgccattgcttttggtgtttcagtcatgaagtctttgcccatgcctatgtcctgaaaggtattgcctaggttttcttctagggtttttatggttttaggtattacatttaagtctttaatccatcttgagttaatttttgtataaggggtaaggaaggggtccagtttcagtcttctgcatatggctagccagttttcccatcatcatttattaaatagggaatgctttccccattgcttgtttttggcaggtttgtcaaagatcagatggttgtagatgtgtggtgttatttctgaggcctctgttctgttccattcgtctatgtatctgttctggtaccagtatcatgctgttttggttactgtagccttgtagtgtagtttcaagtaaggtagcatgatgcctccagctttgttatttttgcttaggatggttttggcaatgcaggctcttttttagttccacatgaaatttaaagtagtttttttctaattctgtgaagaaagtgaattgtagcttaatgaggtaacattgaatctataaattacttcgggcagtatggccattttcatgatattgattcttcctatccataagcatggaatgttttttcatttgtttgcgtcctctcttacttccttgagcagtggtttgtagttctccttgaagaggtccttcacatcccttataagttggattgctaggaattctattctccttgtagcaattgtaaatgggagttcactcatgatttggctgtttattatcggtgtataggaatgcttgttatttttccacatcgattttgtatcctgagactttgttgacactgcctatcagcttaaggagattttcggctgagatgatggggttttctaaatatacaatcatgtcatctgcaaacagagaatttgaataccctttctttctcctgcctgattgtgctggccagaacttccaatactatgttgaataggagtgatgagagagggaatttttgtcttgtgccagtttttaaagggagtgcttccagcttttgcccattcagtatgatattggctgtgggtatgtcataaatagctcttattttgagacacattccatcaatacctagtttattgaaaatttttagcatgaagggtagtgaattttatcaaaggccttttctgcatctattgagataatcatgtggtttttgtcattggttctgtttatgtgatggattacgtttgttggtttctgtatgttaaactaatcttgcatcccagggatgaagccaacttgatcatggtggataacctttttgatgtgctgctggattcggtttgccagtattttattgagcctttcacattgatgttcatcagggatattgacctgaaattttttttattgtgtctctgccaggttttggtatcaggatgatgttggcctcataaaatgagttagggaggagtccttatttttctattgtttggaatagtttcagaaggaatggtactagctcctctttgtacctctggtagaattcggctgtgaatctgtctggtcctgggctttttttggtttgtaggctattaattactgcctcaatttcagaacttgttattgttctattcagggatttgacttcttcctggtttaatcttggaagagtgtatatgtacaggaatttttccatttcttctagattttctagtttatttgcgtggagatgtttatagtattctctgatggtagtttgtatttctgtgggatcagtggtgatatcccctttatcattttttactgtgtctatttgattcttctctcttttcttcttttttagtctggctagccatctattttgttaatcttttcaaaaaaacagctcctgaattgagttttttttttttaagggtttttcgtgtctctatctccttcagttctgctcttagttatttgtcttctgatagcttttgaatttgtttgctcttgctgctctagttcatttaattgtgatgttaggatgtcgattatagatctttcccactttctcctgtgggcatttagtgctataaatttccctcttctaaacacttctttagctgtgtcccacagattctgctacattgtgtgtttgttctcattggtttcaaagaacttatttatttctgccttaatttcattatttacccagtagtcacccaggagcaggtttgttcagcttccatgtagttgtgcacttttgagtttcttaatcccgcattctaattagattgcactgtgatctgagaggctgttatgattttcattcttttgcatttgctgaggagtattttacttccaattatgtcgtcaattttagaataagtgcaatgtggtgctgagaagaatgtatattctgttgatttggggtggagagttctgtagatgtctattaggtctgcttggtccagagctgagctcaagtactgaatatcctttttaattttctgtctcgttgatctgtctaatattgacagtggggtgtgttcaagtctcccactattattgtgtgggagtctaatacccagtggtgcctggaacgccagcgagacagaaccgttcactcccctggaaagggggctgaaaccagggagccaagtggtcaagttcagcagatccaacgcccacggagcccagcaagctgagatccactggcttgtaattctcgctgccagcacagcagtctgaagtggacctgaggctccagcttggtggagggaggggcgtccgccattactgaggcttgagtaggcggttttccctcacagtgtaaacaaagtcgctgggaagttcaaactgggcagagcccactgtagctcagcaaagccactgtagccagactgcctctctagattcttcctctctgggcagggcatctctgaaagaaaggcagcagccccagtcagcggcttacagataaaactcccatctccctgagacagagcacgtgagggaaggggcagctgtgggtgcagcatcagcagactaaacgttcttgcctgccggctctgaagagagcagcagatctcccagcacagcactggagctctgctaagggacagattgccttctcaagtggggccctgacccccgtgcctcctgcctaggagatgcctcccagcaggggtcgacagacacatcatacaggagagctctggctggcaactggtgggtgcccctctgggacgaagcttccagaggatggaacaggcagcaatctttgctgttctgcagtctctgctggtgatacccaggcaaatagggtctagagtggacctccagtaaactccagcaaacctgcagcagaggggcctgtttgaaggaaaactaaaacagaaaggaatagcatcaacaaaaaggacatccactcagaaaccccatctgaaggtcaccaatgtcaaagatcaaaggtagataaatccacaaagatgaggaaaaaccagcacaaaaagggtgaaaattccaaaacccagaacacctcttctcctccaaaggatcacaactcctcaccaaacaagagaacaaaactggatggagaatgagtatgacgaattgacataagtaggcttcagaaggtgggtaataaactcctccaagctaaaggagcatgttctaacccaatggaaggaagctaagaaccttgaaaaaaggttagaggagttgctaactacaataaccagtttaggcaaaacaataaatgacctgatggaactgaaaaacacagcacaacaacttcatgaagcatacacaagtatcaatagctcaatcgatccagcagaagaaaagatatcagagattgaagatcaacttaatgaaataaagtgtgaagacaagattagagaaaaaagaatgaaaaggaatgaacaaagcctccacgaaatatgggactatgtgaaaagacaaaacctaagtttgattagtatacctgggaaaacattcttcaggatattatcccggcgaactttcccaaactagcaagacagcccaccattcaaatttaggaaatacagagaacatccacaaaaatactcctcaaaaagagcaaccccaagacacataattgtcagattcaccaaggttgaaatgaaggaaaaaatgttcaggacagtcaaagagaaaggtcggcttacccacaaagggaagcccatcagactaacagcagatctttctgcagaaaccctacaagccagaagagagtaggggccaatattcaacattcttaaaataatttttaactcagaatttcatagccagtcaaactaagcttcataagcgaaggagaaatagaatgctttaaagacgagcaaatgctgagagattttgtcaccaccaggcctgtcttacaagagctccttcaggaagcactaaatatggcaaggacaaaccagtaccagccactgcagaagcataccaaattgtaaacaccatcgacaccatgaagaaactgcatcaactaacaagcaaaataaccagctagcatcataatgacaggatcaaatttacacataacaatattaaccttaaatgtaaatgggctaaatgccccaattaaaagacacagactggcaaattggatgaagagtcaagaccaaatggtgtgctgtagtcaggagagcaatctcacgtgcaaagacacacataggctcaaaataaaaggatagaggaatatttaccaagcaaatggaaagcaaaaaaaataaaagcaggggttgcaattctattctctgataaaatagactttaaactaacaaagatttaaaaaaaacaaaaaaagacaaagaagggcattacataatggtaaagggatcaatgcaataagaagtcctaactatcctaaatatatatgcacccaatacaggagcacccagattcataaagcaagttcttagagacctacatagagacagactcccaaacaataatagtgggagactttaacaccccactgccaacattagatcaacgagacagaaaattaacaaggatgttcagtacttgaactcagctctggaccaagtggacctcacagacatctacagaactctccaccccaaatcaacagaatatacattcttctcagcaccacatcatacttattctaaaattgatcacataattagaagtaaaacactcctcagcaaatgcaaaagaatgaaaatcataacaaccaacctctcagaccacagtgcaaacaaattagaactcaggattaagaaactcactcaaaaccatacaactacatggaaactaacaatctgcttctgaataactactgggtaaataacagaattctgacagaaataaagaagttctttgaaaccaatgagaacaaagatacaatgtgccagaatctctgggacacagctaaagcagtgttgagagggaaatttacagcactaaatgcccacaggagaaagcgggaaagatctaaaatcaacaccctaacatcacaactgaaagaactagagaagccagagcaagcaaatcaaaagctagcagaagacaagaaataactaagatcagagcagaactgaaggagacggaaacatttaaaaaaaaaaaaaaaaaaaaaaaaaaacatcaacaaatccaggaggtgtttttttttgaagagattaacaaaatagactgctagatagactaataaagaaaaatagagaagaatcaaatagacacaataaaaaatgataaaggggatatcaccactgatcccacagaaatacaaactaccatcagagaatactacaaacacctctacgcaaataaacaggaaacctgtttaagcgataagatgctctttcaattggaagagtctatatatagaaaggctttacagatatgagattttattgggaaaacgagaccataagcagtggctggatcttcattaatcagcctgtatttcatattacattttgttgattttaaattgttgaagtttgagacagtaaaatggtgatcttataggatatacaatgtacctttctacatatacttcccacttaggagagcatatggagttaggtataccaggctcttttagctataaaatacactattcatgtacctgcctttttctgattacaggctcgtcaacctactttttaaaattgtttttattcatttaaattttttgtggatatatacataggtgtatatatttacctattttctgattatgatgtggatgcccatttaggcactcctattctgtaagttcaaaggagcactagaggtcaaaagccattttgtcacttaataagaaaaatatctatttttaaatcttctcttactgttttatgaaaggataggacacacacaagaataactagagcatacaccccaataatgggaactgaccatatgtgattcaataaaaaacaaacatattaacagccttatctttcaaattcatacagtatagctctttatcctcagaggttgaagtccgtattttcattatgtctgccctttctacctcactgaactaagagaaaacatacaaatgtgtactacgagtcaatagtaaagtaatcctcccctatactgcaaactaaggacgtaggattaatagtttctcccttagagctaaaaacaggggtaggagggatactatcgtgtatagaagcaataaaaaggggttacagtattcagtgttcagccatgcattatccaaaggagaagaaacatttcaagtcaacttaatctgatcccaacttcacaaactaacatttttgttgtaatttgctttcccaagtacatgtgcttatcaagagcaatatatttgtcaattgtatgtgaatattctgctgcttgttatatctcatttaagattactgaatttccatttttatttatatatcactttttaaacttaaagttaactcctcccaccccaatgtggatctgctagatgatctgaggcaatcaggcttctgcgtctgcaaaactgagtactagattctggttgataataaattcactggcaaaaggctgtcttctgggtcatttttgagttttcttgatgggacctaccatccatattgaaagatctcctgttttggaattgatgaaatcgatttaatattcccaaaagcatttaattatcagcttctattgtagaacagcttctacccaaatatcatcttcaatcccaccgatttcacttttccaactcctgattttagagtgtagtaaagccttgagaattgagaacagaggctaccatttcaaaattggcatggcaaaaagtgtacttcataggctagaagaagagtagaggtcacagtgttattatctctgtaatctctacgtctggaaggtatgactatgtagcaccagagataagagtcaaagttattgaagtgtaatgtaataaaaatataaatacacttctgcctatcaactaaagaagcagaaaatgagtaaccatccaacagaggatctccccagagtgaaaaattacaacagaagtagtggcaggaatagatttcctgatttaaatagtaaaccatgttgccttttatagagtatatgaatgaaattggcaagagtagctaattaattatagctgattactctatcaaatctcttggtagcataagcaaaacattaactttttataattatttggagtcaatgcactccaaatgcagtatgctccatccatagggcatacacattttaaaggcttttttcctaaaagtcttcactgcaattttagatactggtattttgagaactagaattaaataagacaattcataatatagtgcaagaaggctgaacattttaaatatatctacagtattggaaaacttaagatatgtagttttgtattttgtgtagaaatgacaagtctcagatgaaaacattaaactctaccatactaaaagcagtggtagtccagaaatttaccaaccttcaggatcgagtagtttctctatgcctaattgatatctggcgatgttgaatgcatgttccagtcgttgtgtggctgactgctggcaaaccacactattccagtcaaataggtctggcctaaaacacatacacatacacacatacacaaagacaaatataaatcaatctagaatgttccatgagatttacttccatgcttaattttcattgacaaccaatgcccatagtccttaagtcttgagtgtaattcatttaccctttaaaatatttctatttaaacaagtaataattttaatggaagatctcattgggtgtggtggctcatgcctgtaatctcaacaatttgggagacggaggtgggcagatcctttgagcccagaagttcaagaccagcctagacaatttggtgaaaccttgtttctaccaaaaaaaaaaaaaaaaaaaaaaaaaaagaaagaaagaaagaaagaaagaaaaactagctgggtgtggtgtcacatgcctacagttccaactactcagaaggctgaggtgggaggatcacctgagcccagggaggttgagggttcagtgaaccataatcgtgccactgtactctagcctgggcaacagagtgagaccctgtatcaaaaaagaatgctgaggatgtataccttaaatacatacaacgtttatttgtcaattatacagcaataaagatgtggggaaaaaagaaaatcctgaagatgacaaataatctacgctagcttatccaagcaacaaaaatttatctatctcatccagtctcgtggatttcaataccagccatttactggtaatgcccagttttatatgtctaacccagacctcttccctaaacttcaaattatagattcttctaaacactcattatctccatttagtaatcacaagcttcaagtgtcctgaactgagcttctgatgtttatcctcatcatactcccccaaacctacctacttttcttgctgttctcccttcctcaataatgaacaatgtgtttaaaattgcagttgctcagataaaaacccttggagtcatccttaatgactattttactctcacacaacatttaattcaaaatgtattcagaatttgactgcttctgactatcctcactgccatcactctagtccaaaatccattttatcttgcatgaattatcacaatagcctcataactcttctctcactcttgcctgcgttaattagtgcatagcagagttgccagagtgatctgttaacatgtttcatcatatccgtcttctcaaatctctgctttaggggaagtacaaattacgtatttcatgtgatctacgaagtccaacagggtccaggtccctattaactctctgattttatttcttgtctctttcctcatattccataaacaggatccatagtttcctgcacttggatttggaattcgcttttcgaagacataaacatggctcactcctttacttccattgggtctttactcgaaaatcacatcactgataagttcttccctgcccaagccctatctaaaattgcatgctggccaggcaccttggctcacacctgtaaaccaagcactttgggaggctgaggctgaaggatttgcttgaggccaggagttagagaccaacctgaaccacatagtgagacctggtctctacaacttattaaaaaaaaaaaaaaaaaatagccaagtgtgctggcatgcccctgtggtcccagctactcaggaggctgaggttggagaatcacttgagcctgggtggctatagtgagccatgattgtaccactgcactccagcctgggtgactgaggaagaaccagtctcctaaatagataaatgaaagaaaactgcatgcctcaaatcaaactcacatatacttattttctttctccttatctgctttatactattctcattaacacttactatttaacgtattatataatttaattaaatttctctgtgtatctttctcttccactagaatgtacaatcttttattgcctattttgttcactgctggaaacctagcctgacacaaaataaaggctcaacaaatatttatcaactacacgagagaatggatgagcacatgaaacttacataccatgttacttgataatagagaaaatgcaaaggagtgtaagaggcagttcttgtcttataaggattttaaatttaatgagcaagaaaaatgaagaagccatatgaattaattaaactctaaatgtgaaaaaacacagacaataagaaaatgttttgtaaaatctgaagcggtcaagaaagttttctgaggctgaaagacagattaaatagacgtttcgacttgcattaaaaaaaatgtattgataatagaattctaagttgtgtgagcgttagagaattaaagttcttagggaaggaaaaaagcaaaacatgctcagataatcaagacctcacaggcctggctccattggaagattctaagtatcaagtggtgggagataggtttaaaagaaagaaactggctgagtttgcataaggtgttggctgttaacgtattataatttatcccaacagcactggaagtcattagtcaagtggttcttcacctattctgaatcacagacacctttgagaatctgttgagagctatgaaacttctactcctacaaaaaaactctccatatctgtgaacagagtctacatacagttttagaatatttgaatctattaatggactcctgtttaagagctcatgctatgcaaaaacaaaaaaacaaaataacgaaaaaaacaaaaaaaaagttacaaaggtagtttagctgttatttttctaaaactgtaattcaaaattggccaggcgcagtggctcccgcctatactcccagcactttgggaggccgagacgggtcaatcacctgaggccaggatttcgagaccagcctggacaacatggtaaaaccccgacactactaaaaatacaaaaattagcagggcatggtggctcgtgcctatagtcccagctactcaggaggctgaggcagtagaatcgcttgaacctgggaagtggaggttgcagtgagccaaggttggcccactgcgctctagcctgtgcaacagagcgagactccgtctcaaaaaaatacataaataaaggtataggtttattggtttcttcttaattgcttctactctagttaatacaccagaatttttacaattattaggaaatcgaatccctccatattttccaatacccctaacagctaacaagcttatggaaactagcttatttacaaattggataatgcctttgttatgaaaaatatataaaaaaatttaaaaattgtagaatatttaggggacttttaagttcactatgcgcactctgccttatcttcatttttttctgtaggcaatgggagtaaaaaaaggacataggtgggaacatatgagaaactagttttctcatctatggcatagtatacaaggttaaattgagtatgatgagaaaaaagagcattgcttatgcattcgtgctgtattcccttgtcttaccttccccatttccttggccactaactaaccaactgagtgtgtggatatcttatctaagtcatataatttatttgagctttggcattctcattcaaaaagcattgaaccaaaaggcctttgaggtcacgtctagcattaaaaatgaattgaattcttttatactattaaaattaattaacattttaaatatctatgactttcaaatgcataaaaattgtaaaactaaccaactatgaaggaaacccacacagcatttaatgttaacctggaccataatttattgacttgcaaccaaggatcaccagatttttaattaaatcaacaccatgattaggatagtgtaaatttaaatcctagctctaccacatgttagccaaacagttttaggtaaattacgtaacctctctatgactcaatttatctatttgtgagatgggtaaaatgacagcatctacgtcatggaacttgattgaatattttacctagaacggtgtctacaaaataataattgtttaaaaacattcgtttctattattttgctgtaatgttaattacatttatataagaagagtgatgtattttcaatttacagactcaagccaaaaacacctatctttacagaactgatataaatgttacaaatactactgatgcaaacagaatgtaatccgaaatgggaggtggagaagaggcgagagtaagaatgtgtgatgattttctcgtttttcatattggtcaaaagttcctttctaaacttggtaaaaatttaaaatgaggtatactcataccatttaatgtaataaaagcaaaaattacaactataaaatgattataagtaataaaattaggaaatacctggggatgaaacataatatggctggttttcatactatggagtaaatacctatactgttagaaattagtttgtcaacaagtagaaacattatcacacatattattataaccagcaggaaccaaagtacaagtagctgacagtgactgcatctaagaattgaaataaggtaagttaagattggggtcatgaagacacattgtgtttctgttttccctttgctcctgattctagtgttcatttgcttctaatttgctgtggtaatacactaaaataaggatttaggaagacaattgtaactttatagttattgtaattttatctgcatcttttgtacatatttctaagcaattatcattgggttttaacacaaaaagtagaaatctggcttcctttgaagggtattgtagtggactttgcgttttatcacacaacttttaactgccatgacacttagtcaatccttatgctctatattaactacatgtctttgttctgtatagttgaaccactcaattattgaaatgagggcacctcatgacattcctaattgtgccaacgacaatcgctatggaacagagagttcaaccatttttttctttagataaagaatatgaacatctgccaaatacaaaaagaagggggagatgattcatgaaagaacattaaacaactgtgaagaacctcttgaaaagtaaccatgtaatacataaagagagttactgatgattcatccaatatgacaggagagagtatataaatgaggatattttgacagagaaagagtgggtcagggacagataaaacagggcaatttgggtatgtttactgtattacctacaaatgtattcagaaatcattaaatagaatattaacaaatatagagtgggaacatgcttgcaggattgaagtcttccacttgaagggaaaaacgttagagagccaacaaggaccacataacctgatccttgatatttttattcatctgcaaatgtgtacatgaacagcaaaatcaatattttcgggcccttagtgttaagcatgtggctgcataaatgagcattgacttaaaacacagacagaatgtctctatcccttctcatctaactgtattgaggctgtggaaacattttcttctgtcatacgagaaacaatgtgttaacgctgcttaacgtgacatttgaatgcatgtctgcctctgttctaaatcaggttgctgagtaattcacctggaaacccagtcgggatggggttaattaaatccagctggagcaagacacctgacaaagatgcttatttgaaatgtgtttgctcttggactgagctttaccttagagaaaattaatattcttagcttttctagaagcaggattggcataggaaaatggtagagtggtcaaaaaaaaaaaaaaatcaaagtgagaaaacataacttgcactgaaaattaggcaagatgcagtccagtgacattttaaacagttaattaggcaatgcatttagccctgggttgggtaaatgaaacgggtaacaggaagaccaaaataaagtgactgtagtccctctctctcaaatacacacacacaagcatatatatatatatatatatatatatacacacacacacacacatatatatacatatatagagtataaatggtgtagtatatatggcatatagtatatattgtatctctaagtgtatgtgtacatatacatatgtatttcctacactgctttgctttttcttgaactgttattaattcatttactgaactttacacaagaaaagcaaaaaaaatctttttcatcttaagaaatataatgttgaatggaatatagttaaggactttggttcactgtattacagtgaattctttttattaaaatccacaaaagatctctctcttgctttatagcaattgatttgctgttccagtgcaattgtttctgttggtattcaaaacattgtgtcatataattaattgtgttctgctctttgtcttggttactaaaaatgctctgagcatcttatgaccctgaactagaacaaagtatacagggctttatggtgtttgatatcaaagtgtgtatctgataagacagatgtttctttctccacactacgtatctgatgatggtaattaatttaactacaactactcacatgagatctagtatcatttttacctgtatagtttaggcttatacaaacacattatctgtataaaaagaccaacaccattctcggcaaagttagaatacaacctggatttactgggattcccagtgtcaaacatattgatactctccccctccactataaccactttcacgctccgctaatgttaatgtttcaacaactgaattatatgtatcccatagaacactggaaaatattcttaattagttcattccaatggaacgttagatcaatgtggtcaatgtacataacatgttgtaaagtaggacatgatctggaaccatactggggaaaaatatgtcatcagagtctaaatcaccacttttacaagttatttaatgtctcagtaatcttcttacctatgactatggatgagagcattcaaagccaggccatcagaccagctggtggtgaagttgattacattaacctgtggataattacgagttgattgtcggacccagctcaggagaatcttttcactgttggtttgttgcaatccagccatgatatttttcattacatttttgacctacatgtggaaataaattttcataagaaaatgcattccttgagcaagaaccatgcaaacttaaatatgaatgtccttgatcttcagtgataaatagaaattttagggccaattagtaatgagacataatagattctaccagaagttaagtctattctcaaaggctaggagtctattctgattcattggtatctatgccataccatttactgaatgtgttcactattactcctggattctgccatattagacccaacatttactgtttatagaattgctcaccttctagctttcaatgaacaagctagagaagacagtgtataaaacattagacttattgttaaccaaggacttaagatataaaagcgctttttggataggaggaatactatagataattgttttttaaagtatatgttcaaattttgcctttgctattaattgtggtaattggacaagttgcttaacctcttctaggcctcatttctgtgtatcttacatgcaaggttagtgtaagatcaaagtacaaaatatggtcagataaaacccctgatttcataccatcatttaacgcaagctatatttattggctgaactgaaaagaagacagaaatgtttgcctacctaaaataaagaaaaaaaacaacaaaggaaggaaatatttatccctaagaggtgtacatatgtagccttggttctattttcattacttggtttccatgtatttgattgtctcataggcttcgtgcatgtgcagatgttattcaacagattatcaagtttaattcttctgagtcatctgatgcagaaatccattctaagcattttttctaagtttcatgaatgcagtgacgcttcatagaaaaaactgtctacatcttttattaaagaattattatttattaaagactgctttttaaatataagccccttatgagatgctggaagaagacatctatgtaaaagtgatcagtctgtaccactaagcactttccttctgggaaggttaaggttcatatactatcaacatttgatcagatgatgaatatttattgtgcattctaaatatgacaattttattttttcatccatatagaagttaacaaatgcctttggggtaaatgcatattttaacatctccaatgttagtcatctttttattaaaaagtaaatgcaaattttaggatatactactaaatctcattttaacatacttttaaaagatttgagatgatgctttgtaaacacagtaacgattcggagatatgaaatctttgcatgtatctgtcacaatcccttgataactaagcctattatttaggagtggattatccaagttttcctaattccttcttgacctacttatttagtcagttactcagtgaatacaggtcaaataattacgtaatttgtctcatattctaaaattataaattgctcaacctttatgtacagtgactgcaggaggtgtattttgtgtcctgtgctaaattacggttggaatcagcagatagtggcttaatggtggtaatggatttgcaataatcaagcaatcctccaatgatgaatgtgattcatttgtgaaatgcttggccagtctgccctctatgtgcataacgttaaaggacaacaaagtattcaatccaaaactcctttatagcatcattatgtcactaattcagcttatcagcctcagcctcgctgttattgcttctacttaggtgcaaatgttgctcagacaaaaaaaaataataaagggcaatgtatgataatcatgtctccttttcctacataaaaggcagttatcaaaaaatcattgagctggtccccaaaggtgagcctgtaaacagaaaactgtcccgtcctcaggtctcactgtctctaaaggaggctcaatttaaacagatgtatttgtgtgtgtgcgcgcatacaactataaatcaatttttaaaaggaaaaaagttgaaatgtctttgagcagtgatttttaaaaatgactaggagttaactgggccaagaaggcatgatggacatggaggtgcaccaccaagattgaccttcaaggaagggcttgttgctccagctgtggtcaggcagcttctagttgttagttctctcaggtaccacctgagttgcagagtcctgccagccaatgtcacaccctctctagggcaacccactactattgactgatgaaggggcagagtataaacactcagccattttaaccccatttgagacaactctgaggggtcatcctagctgcaagttgtctatggggtttgaataagcgtgtcatagggtctacgtcacagctctagttcttcctctttccactcctgtcacctctgcccttctacaggtgtttttttttttttttttttttccagggcatggcttaataaacatgctgcctgccaaactcaactccgaagtctactccccagaacccagactgtgattaaaagaagttgcagcagaggaatagaaatgaagagggtaggaataatcttatatggtaaggatagtttctgtgaagctctgcagaagagcagagcaagaactgtcttgcacagaagtgacttggtaggcaggaatttacagggatggctttcagcagtgcgaacgtcatcattctcctgtaattgcaaattgtatcaataatatgaacattctaaagtgaattagcgttgccattaagtacatcccttgaattgtccagtaaaagtatggacctgacttctgatagctcaccactgttagcaagatttgttattacaaccagctggttgccagagccaagtttagcactccgaaaaaaaaagaattgcacttaagaaggaagaaaaagatgccaaacacatgttatatgctttgcaattttgttcaaacctgcctatgttacaaaatatgcgttactgttttaggctagcaattttatttgagatggacagtagaaaaacagtaataggaaaacagagtttgcattcctgagttttcacaagttcaatgagaagtcctccatggcactattaataacatagtatgttgcattagaaaaaggggccaacatggttctatctgtaaatgccgctcgttatctgatagatctagaatgtacattaagttgaccaaaatgtcctttaatctttgctgaaattcaagggcttctaccatttaataggaagaaaatatgtaatgttggtgtaaaaaaaaaaaaaaaaaagaaaaacacatttttagattcactggattatgatgaacactgagcaagataatttttcaaagtgtgcttaatagttttagaacagggcagtgtgatataagagagatgagataagtaagcagaggctgggaagagtctacagtcttgcagtctcaaggatatggtgattcaagggcataaatgaaaaacaacaggctataagagaggtctcagacaaagaaagatttaaaaagcattccttctgatattcctcattgcaaaagcgcctccacatgctaataatgaaaaatgggctgggtgcggtggctcacgcctgtaatccaaacactttgggaggccgagacgggcggatcacaaggtcaggagatcgagaccatcctggctaacacggtgaaaccccatctctactgaacaaaatacaaaaaattagccgggcgtggtggcgggcgcctgtagtcccagctacttgggaggctgaggcaagagaatggcatgaacccaggaggcggagcttgcagtgagcagagatcgcgccactgcactccagcctgggtgacagagcgagactctgtctcaaaaataaaaaataaaaaaataataataaatgaacaacttgcaagcaagtgaagaaattatcagacataatagtcttgaaagcttatcttggactagttcagatggagttggaaagggcttcaggatatttttaaaaatggtaagatcatataagaagtagtataaacaataaatacagttcagagtgccttttggagctctgtgcatgcttgagttcttctgctggctttgtcaaaacttacatctgtcttacgcaaagcgggatctgcaaactggattcactctaggaattatttgttactatgccataagataaagtcaacaattcagagtgcatcaagaaacttatgtagcgattttacagagtaccatttatgtctaatgtatttaataataaaggaggaagcatgggtgttgggcatcttatttttgtaacgctttggttttattctatcttacatacaatggattaggggaaaagtgttccttcctcaagatattttgagaagtactgagcaacatatgaaaagcagtttggggagagatgcggtatgttgcttgctggttctatttgacaccatcactatatggaacgggctgaaaatcggccaacttgggctcacttaaggctcctatgagctattctttgttgccagcacatattaattcccgctctttctcttcccctctccccgcttactgttgtgaagtagcattaagcctgttcagagaatttggaataaaaatatatgggggccaattaggagagcaacatggctgctgaatttaataggtactctttgtgtctactcactatttgactctgagcaagagcaatctacaattcaagttaaaattcaagccgggcgcagtggctcatgcctgcaatcccagcactttgggaggccgaggcaggaggatcacgaggtcaggagatcgagaccatcctggctaacacggtgaaaccccgtctctactaaaaatacaaaaaaaaattagccgggcgtggtgggggggcgcctgtagtcccagctactcgggaggctgaggcaggagaatggcgtgaatccgggaggcggagcttgcagtgagccgagatcgcgccactgcactccagcctgggcgacagagcaagactctgtctcaaaataaaaataaaaaaaaataaaaataaaaaataaaaaaattcaagtttaccgaatgaagccatgatatctgctacaatagggctggatctgaactattaccctcattgcaagaagccagacacaaaagaacatgtattatattgatataaaatatccaaaaaggcaaatacatatggacagaaatagattgacaattgcctagggctggggtgggagtgaaaaatgactgtaaatggagaagaaacttctttttaaggtggtggaaaagtgccaaaattagatcgctatgatggctatataactctgtaaatatcctgcaaattttaatgaacgtggtgggggggagttattcatccctcaaaatagtttgagaggctaccaagaaccagaactaaaccagattgatgcaaattgaattttacacttagaatgagtacattgatggtctaacaattacatttcaaaaacgctgatttataaaaaagtaatcccgaccagtaaaaacagcagtcatttctcagcctccaaattttttaaatgagtggaaaactttaagcaatcaatacaagtcatatgatacacctcaaataaaagtggtatactacactgagtgccttgcagatattctcccacttaatcgtgataagaaatacatacacatttatttttatttttactcttttgatagtgaagggaccatggcccagaacaggggtggcaatataccaaatgccactaagatggtaaccgtggaagtttaaattcaagttcatgttggtatatatatatacacatacatatttatacatatgtgtataacgagttactattacgtatatatatacaatgagtggaaaatattagtggatataagttcatgtatgattatgtatacatattatgattatactattatgtatatgtatacaatgagtggataatattagtggatataagttcatgttggtcttatatatacatatataatgtgtggatatgagtgtgtatatatatacatatataatgtgtggatatgagtgtgtgtatatacacacatgcatattgtatatatgtgtgtatatatagacacattatatatatacgcatatatactacacacacacacacacgggtgtgtgtctgtatcttttccacaaatccttcaacccattttgcagaggtcaaatagacagtcggaagaccctatgctcaggtgacttaaaaataatttccaaatcacattatggagtttgtatgtattacacacatttattgatagagatacccatattctactaatcttttattggcaataatttatgttaagaatacccaagactgagaaagcctcattcctttggtagtgattaaaataaaacatactaaattaacttatagacaagttatagaacatacatttgtgaaaaaaattactcacctatgattgggactttgtatttttaccttatacttactcaatgaaataaaattttgaaaaatattcctgtaaatgtaccagaacctattttataccgtgatgatccttaacatttcagacgacatggtagtgtcaatttaaaaagcagcactatggagcagggtttgttattgttagaaatacacatttgtttcacacgtcaagggtaaaaattaaaaaacaagattaatgttacccaaaaggaaaccattcatcaggattcttacctgccagtggaggattatattccaaatcaaaccaagagtcagtttatgatttccatctacgatgtcagtacttccaatattcactaaatcaacctgttaaagaaaggggtaaaacatttgaaggtaagagaccaaatgcctagttgcaataataataataataaaaacgtgaaggtaattgcatttagctattttcagagacttagcattgaagctttttgaaaataatctaaaaattaaacaaaatgcatgtgtaaaatcactttccataacaaacaagcaccccaaatatatttactttcagcacatgaatagattactgcagattaaagaggtcaactggagtatctccaaataaaatgtcataaagtatgtttaaaattaagatatgctttctagtatggaattacaactcagaaaaattcaccagtacttccacctagctccaaggagtgccattataattaaggctgactgcattttagtaaaacgcctctgttttagaatgaatgttaggtctctaataaacaatggagcaaactgccagctctcttatctctgtctaggactgtgtttggaaatgaaaatctggcagggttttatttgccttaatcaaggcaaatctctgtgtctcctgtccttcacactcctcaaatgtttaaggtggagtaaagttaaacacaagcatctgaaaagcaagcatatgaaaagatgttcaatgtttttagccaatagaggaatgcaaattgtaaccacaataatgtatcactgcacatttatcataatggttaaaattaaaaaatagtgccataaaatgctggtgagggtgtggagaaactggatgactcaacccctgctagtggaaactcaaatgatatagccactttggaaaacagtctggcagtttctcacaaaactgaacatgtacttattatacaatctggtaattgggctcttgagcatttatctcaaggaaatgaaaacacatgtgtacacaaaaacctgcacctaagtgttcatactacgtttatttgtaatagccccaaactgggaacccagatgccctcaggggtagataaacaaaccatagtacagccacaccatggaataacactcatcaatgaaaagaacaaactattgatacatgcagcaaattggatgaatttcatgggcattatgctaagtggggaaaaagtcattctgaaagggtagcatactgtatgaatccgtatctatgagagtcttgaaaagacaaagttacagaaatagagaacagaatagcagttggcagaggtcaggaatgggagtaagatgtggggtagctgaatgttcttataaaagggcaatatgagggacccttgtaatggtggaactgttctgcatattgactctgatggtggatttacaaacctacacacgtaataatgttgcatagaactaaatacacacatatgcatgcacacatacacataaatatgagtaaagctgggaaaatctgaatactattggtggttttatgaatgttgacatcttggtcatgatatcgtattttagttttataagatgttactacatcgaaggggagattgatcattcaagaataagaaagcatcatcatctgcatcatcatctggggattcctcatatggcagtagaggagagaaattcctccataaggaaaagccactatgaatttatctattgattcattgattcactaactcaacaagtaccttttggctatctgccaggcaatgaagtaataagagcatgtaaaagtaaaaaccttctgctttcatgaaacttaattctagtgatagtgacaatcagatgatatagcactaaagactcaagcagttaagcagagaatatgctatttttaggaaacatactcactcatactgcgggaagcactgctggtagatacgttttgggttgccatggacctgactctggggagacttagatcaagtaataggaacttagattccagtaaccccttatccactgtcataagacttgtcactgtgtaagcaggaagatagttcctccatttccttgtcctcataaaaggtctcataaggtccaatttccactatattcaggtactgggctcagacctgataaaggaaagtaaggtactacccccccagtgtcaaaaagttcacaacagaaggtcacataataaaaaagtatctaccattaggctctagcaattctacctctatgtttataaccaaaataattaaaaacagagattaagatattggtagaccaattatcatagtaacattattcacaatagccaaaatgtgagaacacccaaatgtccatctacagataaatggataaacaaaatgtggtatgtacatacaacggaatattttcagccttaaaaaggaatgaaattctgatacaaactacaacataaatgaaccttggaaacatatgctaagtgaaataagcaagacataaaatgacaaatattgtatgattctacttatatgaggtacctaaaatagccaaattcatagagaaaaaatggaagttattaaaggctaggggaggtgaaaatggagagtaatcgtttaatcagtatgaattcaacttgggatgatgaaatcattctagagatggatagcggtgatgactacccaacaacagaaatatacttaaagccactgaattatacactaaaaaaatagaaaaaatgatacctcaaaccctatctagggcaatgaacctgaatagacatttctcaaaagaagacaaaccaacggccagcacataaatgaaataatgttgaacatcactaatcatcagagaaatgcaaattaaaactacaatgaaatattacatcacacagaatggctattatcaaaaagacaaaaggtaagttgtggcaaagatgtggagaaaaaggaatctttgcacagtgttggtggaaatgtaaattattgtagtcatgaaaaacagtatggaggtttctcaaaaaattacaaataaaactaccatataattcaggaattctactgctgggtatatattccaaaggaaacaaatcaatatgtcaaagaaataactgcacttcaatgtatattgtagtgctactcaaaatagcgaagataggaaatcaacttaagtgtccatcagtagatgaaagaataaagaaaatgcaggtatacagacctacacacacacacactggaatactactcggacttaaaaagcagagaatcctctcatttgcaatgaaattaatgaatctagagtacgttacgtcaaatgacataagccaggcacagaaagacaaacattacatcatgtcacttgtatatgaaattttaaaatgttgagctcatagaattgagagtaaaatgttggttagcaggggatagagcttggaggaggagggttaggcagatgttggtcaaatgatactaaattacatttaataggaataaattcaagagatctactgtacaacatgctgactttggttaataacaatattgtattttgaaaattgctaagagaatagattttaagtgtcctcaaccccaaatgataaacatataagttaatgtatatgtttattagcttgaagcattccacaacatctagatattttaaaaaatcatatgctacatggtatatacaattttttttgctaattaaaaaataaaaaatagttatatggtaaattttacatcatttgtattttaccacaataaaaaataagtcattggaacacacatcgcaccccccccccacacacacacacacacagcagcagccacagataatacctaaataaatgttcatggtttttttccaataaaatttatctatatccacaggaaaaacaattaggtaggcaactgtgtctcacggaagcccaaggggtaagaaaaaggaagtaacattgtgaaaagataagcaaaagacataagatatattcatgtactcagtattgattaaatctgtaaagaaaaaatagattggaatgaagaaaagtatcaggtggagaaagcatgccagaaagcattcagatcactagggggtaattaactgattgggaattggagatattatattcagggacagaattgtattcagtggcagacagctactcttttttaacttttatattaggttcaggagtacatgtgcaggtttgttacataggtaaattgcgtgtcatgggggtttaatgtacacattatttcatcgcccaggtaataagtatggtgcctgataggtagtttttctgatcctctccctcctcccaccttttactcttgagtaggctccagtgtctgttgttccccactttatatccatgtgttcttgttattaactcccctttttttttttttttttgaggtggagtttcgctcttgttgcccagactggagtgcagtggcacgatctcggctcaccacaacctccgcctcccgagtttcaagcgattctcctgcctcagcctcccaagtagctgggattacaggcatgcgccaccacgcctggctaattttgtatttttagtagagacggggtttctccatgttggtcaggctggtctcgaactcccgacctcaggtgatcccgctcgcctcggcctcccaaagtactaggttacaggtataagccactgcgcccagcctaactcccacttataagtgagaacatgtgatatttggttttctgttcatgcactagtttgctaaggataacggctccagctgcatccatgttgctacaatcttatttttgtctgggttgtattccatggtgtatatgtagcatattttcttaatcagtctactgttgatggacatttatgttgattccccatctttgctactgtgaatagtgctgcaataaacatatatgtgcatgtgtctttatcgtagaacaatttatattcctttgggtatataccaaataatgaggttgctgggttgaatggtatttctgttttaacttctttgaggaatcaccacactgctttccacaatggcagaattgattaacattcccaccagcagtcaccacacctggccaatatcttatgcatacattttcagatactgatgcttctactgttattataacaattcacaggatgtatatactggatcagagtgtgtgtatacacacacacacacacacacactctgctctagtagatacatctatacatatatatatacgcatcatttcagggagatatagacatatctatacaagtatatgtgtatctacacatatacacatatatatctatacatctatacacatatatacatatgtatacatctatacacatatatacatatgtatacatctatatacatatatacatacacacacatatatacacatatatatgtaattttagtaggtgtttccacctgccttcctagaaacaatttagaattacatattttaaccagaatgtataagaataggctcttctctcaccaggaaatttttgttttgtttttgattcttttagttttgtttgtatgatcaaatacatcactttgttaacttttatttccatgattccttgtgcatttgaatatatttttgtatcactgacctattacaattccatgtgtgaattgtctgttaatatgttttgctcattaatttctatatggtagttttcttttccttcttgaattttaagagctcttggtaaataagagataacatttgtagaatgcttaccacttgcaaaatgtgattatatttcttataattcaacaaaattttgtatttcattcaaaagtaaaactgtcttacagatttatgatctttgctttttgactgttaagtacaaaggttaacctgacatcacaaaaggaattgtggagtttttttcttttcatatgctttggaatagcttaaagtatataaattattctttaagggttacgttaaattcatttgtaaagaatcctactacactcttcaacagtacacctttaataacctactaaatgttttctgaagtaatcagtctaattttccacttattcttatctcaattttagtgatttgtattgtacgagaaaatcaagttttccagaattttgcaaaattgttataaaattgcttttagtttccacttcatttcttctgtatctgctgtcatgcgtcttttctcatttatctcgtctagtttttattctaagttttctttgttatgactgggataggtttacctattttgttaatcttttcaagagctcacttttgaatggattattcttattcaattttctacgttgaatacaatttttatttttgtttctatttttacaatttcttaagatgcatacttcttttatttccatcttttaaaaatcttatggctatacagttctctctgaatacagatttcactatgcctacatcattagagtatgtatgagctatataaattttaccaagagttcatgaacattttacatttatgtgcattttaccaagagggaaacagagtatcaaagataaatgaagcttccacaaggtctgatttaaaactatgtctggatagaagatatttcattaattacatctagtgaattctccacaaaaagctttaagaggctctctctccaagttaataaacatttcacaccatgatacagacaaggattattatttattttggttgtgttttgtctcttgtacatgtcttcttcaaactaccaaggagtgtaagaaatgctaattgataaccatgaagactctagaggagggaggtatttgtcatgcctgaaagggtattgttcatggcatttatattactcttcaatgcctcacattgacggtctggtctgttttggccatgaattctcataagcttgttgctcttataatgctgtatttcttactattagctgtaagtcataacatttttctgaattcagtactatttcctcttaaataatcatcaccctgccatacagtaacttctcttttatgtttttttttctaatacacattccagaattatgtctttcaagaattatcagtctaattgctaaataactgaatggtaaaaatattaaaaccttttaaaatctgtgtgaagtgaatgattacatctgtctactaagcaaaacagaaaacattaatatgacatgtatgttaatgtacgagcctactgtgtgtatcagtgttgtgacaagcactctatggttggaaattaaatagtagggtcactgtggttacccaaagttctgctttcctgttttgcacaatgaaaacatctgataccaaaataggtgtgaaaattgatattctgtgtgaaaatgtaataacatgccttgagtttttgcagaaataagttaaactacgcagcacaattggcttttgtagttcctgtcaacaggcctaagattttactcataaagtaacatgggatgctgtctcagagttttacactgttatcttcggaagttgctttattcaaatgtaattttggaggatagaaaacctccatggtttgctttgacataatggaaacttattgtgactccagtagaatattaaaatgtgaactctttagaaacacctcaagttacaataagcagtctgtaagaattgcacatagaaaacctaatacattaaattattctttagtatggagtagtctcctgctgtctattttaaaggcataggacaagaacttaagggggtccctcttctatcgccagactagtacttacaatacataattttgtataacaatatatatttagtaattctaagattaatatataatcatttcagggagcatttacttccaggtactctacctcctaaatgactgggctatgaggaacaattctcgtcatttgcttgttcgagacaggcaaaaaacctcgctgttttcttttatcccactttccttcaggaacatggatgtaatttctaccatcgtcaatattttattcaagctaagattagatatcccatgatggtttacagtaaaaggatttatacttattatattgatatattcaagatttaagaatacttaagaaaaacttaagatgaaagtaaacctgaaatatgatggttttctgaaagattattgacaggaacaagttagtgttatttttgatttgctttacagaaagaagaatagcagactagggttcatcaaacagaaaatagtaaataagacgtcagaatgaggggcatgtaacttgaaaataatttcaataaccaagtcaaataatgaaaatggaagttcttagggcagagcagaaggagagagagaagggaaaatgatgaataaaactaagagttacattcctgtaagatatttacgtgtgtgtgtgtgtgtgtgtgtgtgtgtgtgtgtgtgtgtgtgtgtgtgatgtgtggtttgtgtatgagagagagaaaaagacaggtgacaaagttctgacaaagctttaatgaattttttcatacaattttatttttgttagatgcagagagagatggatgtttagagttttgtgtatcatttaagcatttgcggttttaacttggaagttgcagaaagttatatctcattcacaggggaaccatcatctttataatatatggtgtctgcctcttcttgcctttttagacaaccagtgacaaggacatttcagagctacaggctctaatgaaaacacgtcctgcgtcattcagccaattgaaattagactaaagcaggtcgtttctcacatttgtttcaaaggaattggttctcccagatcatttcagagtttgatatttgtcctaagaaggagtcacttttgttccctcatatgcagtgtaaaatacaagcatttttaaaattagctaagggagggggataagggtaagctaccttttcactcagtcttggtgattttaactagatatgaaatggtacaaactattataaaataatttcacaaaaagattctgaaaggaaccctgaaatatccttaaaagtttgagttgatttccttaaacagaatcttaaacaataactaaaagggaaatcccatgcattgaaaattattatgtaaatatccttcctgacactgaaacctcaagcatgtacttccaccatctatttggttctttcatttcttttcatttcatttcgttctcataaaatatatataaaccgagaagttccttccaacattctagataaacagaatttgctttttaaacatgttaaatgtcttttataagatgtctgccatcatgtagccaagctaaagacttctccatattcaagagaaacttctcaagtattcatacaatccttctaaatataatgcattttaaaaagataaaaaatacaggaaaggcaaagtagtttcattgccctgcagcatgtgcttttacaccacatttaagatttacactgtttaaaatttcaagacttatgggcataaatcatacctattttcttccattgagagatgcatgtattgaatctttttcttattaaatcataaatacgtcgatatatacaacctaaacggtgggccatattgccactgtggacctggatttccaatgacagctttttattcccttccttatctccgtatttcaagaattatttttgattcagatatagaaatttacattagataatttttgaagcacattttgacctcaactatattacaagatttaattctgggtactcactacaaagatactatctctaccttcaatgattaagttttacatatttagtcattctttaactatttttgaccactcactatatgccacgcatagaatgttaagaataaatttaaaaaatagactttcaacaaattgcttatggacaagtgaaatgttaaatttcctctatatttcagatatgtttatgatcactctgatacattgcaggagaattatttttaatggagtcatgttttcatttgtttatatactgcctctttgacaataaagaattgaggcagttaatacaagtgtctcataatcctaagaaaatatgaacatttaatggcatgaaagacattaaaacaaatttatcaaaatagaagttttgatacaggtaatctggttgaacgtattaataaaatgcaaactaaactttttgggaaagtagctcttttaactaaactcaacaaaattccttatatagaatatatattagagggcattgcctgagtaaatggacactgtcctcaatactttcacaatttagtatgaaagatatatatactttcagtatattatttaatttgaatttttgtaattacgtatcttttatctggcaatataggatgtaactttaacgacaaaaatcaacccatatagccccaactttttaagctcaagtcacgtatactaatttcaagtaaaaaaaaaaaaaaaaaagcaatagctacaataaaaatcttaaaagatacttgagtgacattataagaaatatttttaaacagtactatttatagttatataattattatcccagcagacctccatatgtgaacataataggtaactggctatctcaatttgaagttgaatatacaagaaatgtgtcaatactaatttcccttaaagcaagaggtatactaagggggatgggaagaataaacaactcacccagaaaattattttaaatgagaacatgctgcaatttaagagtagttatattaccttgcaactgaatgtgagtttaatgaatacgagattatgtttgtatatttgtatcttccataacaagtattttgaaagaagtgaacatttactattaatgcatttcgcagatgataaagtgagtcaaagtcacggaatcatttggcaaagaccctatagttgataagttacagagttaacaagatctacctcttctgcaaacttgagaattaatacatataaagtgcaaatattttacaggcctattgtgtggactgacaattttgtgtaagaaatacttgtctaacaaattaaatttggaatttgtacttaaatactagattttatgagtaataaatagaagtagtttatagtcaaatatattctgacatgctccaaaatatgtattatatggctatttaagtttctgaatacttaaaggacacataaaatactagttttaaagaacattttagaatcctctttatctaacattatatgccagcatgtgaacagtatatcatttttcagatcagtgacatctgacaaccattcaatctaattcagtgactattttcaatgatggggttaagtgaatatttgaacatagctgtcatctgaatttccaccctaggctttttaaatactcaccttggatttgtgatttaatgtatagcaatgactatttgctttgtagtatcccacattgtagatttgaagttacttggtaaaaacttaccaccttgtgatagacaattgatgagctggtacaatgaacataattattagatctacaactgtgtcagttaatattaaattatattaagtcagcgaagtcttggtaatgttcctagggtatatttcaacactataccttttgtatgaatctttataaaagggatcggaattcataaaatgtaagcaaggaaatcataagagggaagacgaggacacaagcttggagaaaggaagacagatcataatacatcttggggagcggggggtagtttaaagcaccacagttaaatctctatcaaatttgtaatttctaagttcctttaccagacaaaaaattaatcattaaactagacacaaaattattaaaagtgcaaatatctaatagagaatactcactgattagaacttagttatatccaaggaaagtttaaattacccattaaatatctttgagagaatagagttaagtgtagaactgaatttaaaatgcctaatgaaaggcactacttacaaacaaaagtgggacagggcaaagaaataatagaatggctgtataagagatgtttcatcctagctgggatttgctttaccttcaaaaacttgtaaataaaaagaagctgtggatacatttttacctagagctgatgtagagacaagaataaccacttagtagcatagtctcccatttctcaggattttgtattttgttcgctttttaaaatcacaaccaactattacaaatgagctttgctctcagcaaataccgcaataaagttatcactgcacttagaagtactttcttctcaataagtggctttccaaaatacattattgacagcagggataacttcatgctaaaacagccaccacaaagaatgcaaattggaacacagacgtagtgtctgagctctacagatataagctgagtggcattcaagtgaggataacaggttaaacgccaggacagggaaaggaaagaaactgaggaacagggttaaactgaggagctagtttagaactacagaatatgctagaactagtgatttatggcagagggacaggctaaaatggaggagaccctaaggaaaagagagaagacaaaatgaccttgacttaatgatccagaaattaccaaaaagtatcattttgaaaagacacttctaatattcctttaaaaatcagagggctaaattttgagtgatttttttaaaccagggtttcttttcataggtttatagaattaggaggctgttcatatgattttctattagcaattatcaatttcttggtgtgtggacaaacttatcactggtattcaaaaaaaaatttttttttttggagacaagtcttgctcgatcccccagactagagtgcagtggtatgatcacctctcagtgcaacctccgcctcatgggttcaagtgattctcatgcctcagcctccccagtagctggaattacaggcgccagccaccacacccgtctaatttttttttttttagtagagacggggttttgccatgttggccaggatggtctcgaactcctgacctcaggtgatctgcccgccccagcctcccaaagtgctgggattacaggtgtgagccaccacgctcggcctcaacttcattttttataataaacatatatgtatttctgtgtaaaacccgtttttggtttctatatctcatacttaatatttcccttccatttttaaactgcatacatttgtttttctccctccttgtctggatcacattcataagatattaatctatttcatattataaggaactagctgtatattttatctagtgtttcttctatttctttatctttagttcctgctttccttaaagcatttttgtaacatttttatttgaaagcttgattcaatttatctttttaatgaagatcaaaatcaaagacaaaaattcaaactctcagtacagcctgagccatttctcatgggttttcatatggaatgctttttccttcacaaatgtagttttatactcttggtttaacaaaccttaatcaaacttaatttataagtatattattagtttctactgttattaaataacatgaattttgaaagtttgtgtgtatttaatgacattttcactgcattcaaatatattgcccgtttataatttgtgtatgtggcaggaaattttttttactattttcctaagcctttaacaagtttacgacgaagagcagatatccgaagtgactctcagcgtgtctttcttttctggctctggttgtctccagaagaataggaaggagtccttagtccccaaattagccagaaaccacgtctactctctgtcatcaaatagaagtggtatggcctcaaaggtgactggcttcctgatgcatccaacaagactgggccctagccaacatcagagttctcggcatgcagattctcaagtcctcatttcgcacagaaacaaaacagaactagatacctggaatgccgattataccgttttccactcctacttcactaacccaccaaacttcttcacctcttctttgtatgtgatgactacatcacctggaatctcttaaccttggacttctggttagactaaactaaggagcggcactggcaaaacactggaggattctatggagagactaaggtatcacttctctcaacttcaccaggcaatgatttgaaactaacagcattctttagatacctaggggctcagttcacagttgtgtccagtggcgctctcccaacatgagggattttatcaaattaatagccctctccccttgactgcttaggtttagatgtagtaaaggttattaactcatgtgaatccctgcattcttcaccatagtttcttcctttaatcctccccacgtttctataaatattcccctgattacactctcttcaactttttctgtatgccacgtgtttaatatcaggacagttaatacacttgacttcacaagataccttaaaattgtatagtgaatgtatcacttggttgcctcaatgaactgaaaatgaaaatgcttttgccctatgaaagacaccatgtggatctactgagctctggccattccataggctcaggggagagcattcccaataatgacagacatacgattttctgaatgccttgttgagagttcagacttgaatttagttaatgtaactgaaatttttaaactattgctcttcttgcacatccaacttcatagggagatttattgataatgctcatattttatagaagtatctactatgctttagtgttgagatacagaaaatcactattaaacctacagttatttgtactctcaatcttttgctgttaaatatgtcataaacttgacagtggtgaattaatggctctaaaaatatatttccatcaatttttcttcatggatttagcagcatttctactgtgcgatacgttttcgttattgactgtaactttcttgaataaaatgacactctaagtttgttagtattctatcactgatttttcattttgtctgatttttcctgttttatattttttattattctttaagttctggggtacatgtgcaggtttgttacatagttatacacctgcgatagtggtttgctgtacccatagacccgtcacctacattaggtatttctcctaattctatccctcccctagccccccaccctctgacaggccatggtgtgtgacgttcccctcctaatgtccatatgttctcattgttcagctaccacttatgagtcagaacatgcggtgtttggttttctgttcttgtgttagtttgctgagaatgatggtttccagcttcatccatgtccctgcaaaggacatgaactcattctttttttatggctgcatagtattccatggtgtatatgtaccacattttcttaatccagtctatcactgatggacatttggccaacatacatacgaaaaaatgcttatcacttgtcattagaaaaatgcaaatcaaaaccacaatgagataccatttaacaacagttagaatggcaatcattaaaaagtcagcaaaagatgctggagagaatatggagaaataggaatgcttttacactgttggtgggaatgtaaattagttcaaccattgtggaagacagtgtggtgattcctcaaggatctggaactagaaataccatttgacccagcaatcctgttactgggtatatatccaaaggattataaatcattctactatgaagacacatgcacacatctgttcattgtggcactattcacaatagcaaagacttggaactattactgatttttaaaataacctgacttatgacccatttaatttctagtagtgtttttttagtcattgtcatctcatttagacctgagtccaaatgccaacaatggctcaccatgctttcttcttctcacccccaccttactacctctctgctcccctatctctgctatgtttcctttatctctaaactcactctactccacttgctgaggcctcattccaaatgctttttcaccttaaggtctttattaccgtgcctaacccaccttcctatagacaattccaaggctcactccctttctccaggtctctgctcatataggaactgaaccaaaaggtcttctcagacctcttattctatgtatctcttttttattcacttaactgttcctaagtatatatgcttcatattgcctaccatgtggctgtaatctctgacacacaaagggttgtgtttgctctgacaccaatcaatcaacttatatacctgtgaattttaaaaggaaatttggataggacttcttcaatgtgattatttatatcctgcacaggcttattgatatagaacacacccaagctcaactttagaaaaaaaatcctgcttgagcattttgatttattcttcctaataagcaaactaaagttgtacttatggatgttttccatttttgtttatacttatgacaaaatggagaattataagataatgcattttttttttttcactctgtggccaggctggagtgcagtggcacgatctccactcactgcaacctctgctcccaggttcacgtgattctcctgcctcagcctcatgagtagctgggactacagatgcacaccaccacgctcagctaatttttgtgtttttagtagagatggggtttcaccatgttggccaggatggtctcaatttcttgacatcatgatccacccgcctggaccacccaaagtgctggtattacaggcatgagccaccgcgcccagcctagatttacttttgaaaatccatgtgttattgttcagccacaggctaaggtaaaggttcctttgttccaagtttggtttctgcatgagaatgtcttgaggttttgtcctctaacgcataggccagcatcttatgcagctccccattaaagctctagctcagatgaaagcattgttaatatctgcttttgaacaactccttctcaaatttaagccattattttggggccttttccctactaaaacattaggaggttctatattttctgtaagaaatgtggccttccctgaagagattcatatgacatcatattctaattttatattcacttatattcatttaataatttcattagaaaacatggggtctatgatcagatttctatatatggcccgtggagtttcggaggttttaagttcccttcataagttcctcttttaattgaagtggaatatgcatatagaaaaatatacataagtgtacaacttgatgcgttttcttacagtaaatacacatgtgtaacagctatcaggtcaaaacatggaacagtgagcaccgcagaagattctcttatgcgttttactgacttactccttccaaaagttaaccactctcttcaattttaaacccatggaaacattttgcccgtttttgaaatttaattgaaagaaatcatagtaggtataatttgtctgatttatttcactcaaatacattttaacgacttcatcttgtatattgtgtgtagctatcatttggtcattttcattgctctgtaatatcccatcatgagaatgtatcatagtcacttccagtttgggctatcacaaatgaaactgctatgaacattctcacatatatatgtgtttttggcaaactgggaaatgtatttctgtaacttgtatgtctacaatagaattgctgggtggtaagaaatgtgcattttcacatttagtagatcatgcccaactctttaattagttgcctgaattatatttccagaagttaattgtgagatttccagttgatccatgtcctcatcaacatttggcattagtagtctagttcagtcattttggtaattttgtactggtatctcattacagctctaatttaaatttcctcaagttactgctgaggttaaacatttcttaaatatgattcttgaatttgtgaacaccttttgtgttcctgttcaatttcagtttctcattctagaaaacctaaaatttaaaaaaaaaatcaagaaaaacagaagactgggatactccatatgtaaatgtgtcagttattctctatagatttaactcaatgttaatcatacttaaaatgaatgtacatgtaaatggaaaagattacaaaacaaatacaaaaatagaaagggccaataaccaataaaatctcgaacaaagtgggagaacctagttcaccagatactaggctgtattataaaactacattactccacattacatgatatttgtgtgtgtagagagagagagaacaatgcaagagaattgaagtgcaaaaacagacccacatatgtacggacaaatttttaatgacacacttagtactgtgaagcaatgaggaagcattatttttaataaatggtgtgttaattagacttcaaataaaataaatactgagtcttaacctattcctcacaccatatgcaataatcaatttcaggtaaaacagatccaaaaacaaaatggtaaaacgataatggttctatagataataacctaatatagtatcataatggctttgggtaggccagtatttcttcaacaggtcataaaaatataaagttttaaagaataaactatatccaagtggagaacttgtttttattaatattaaccattgaagtgagtaaaaaggtaatccacagaaaaggaaaatacatttgcaactcaaaacaaagggctcatatccagaatatagcaataactcaattttgatgaagtccaagttaacttttctctttttgaaacatgctttggattcaggtatcataaatacttgcctatcccaaagtcatataaatttccttctatatgttttattgccaggatttttctggttcccttggagtaggcagatagccagaaatgagcaggcaagggagccccattgagaaaagaagtcctgaagatgctgtttcactgagtcagtgctgcctgttgacaatcagcgaaacggacaatgaatacacacactgtccacactgattatgtctagccttgtggttgggctcctctagccccaaaggggacttctcaggccctcgccagagataaccacgctagggattttccccactgacaagcatgcacacactcctccaaaaacttgccctattcttttgctcattgtaatagtgtaaacaaacaaacaaacaaaaaaacccacacacccctgggtggagattttagatgccaatgagatgtggtatgtgtgctagcatgtacaaccagagcatgtgtgcccaaaaaacctcccaaaacatacttgcaagtaagaccccccccatacaccctttcatgatttatcacgtaggagtctcaaagttccccagcactagctgctgctggctctttgttcccttgtgttcgtgtgcattcagtgtttagctcgtacttattgagaatatgtgttattcggttttctgtttctgtgttagtttacttaggataatgacctccagactcatccatgttgctgcaaaggacatgatctaattcttttctgtggctgcatagtattgtatttcatgctgtatatgtaccaaattattattatttttttttttgatatggaatctcgctctgcctcccaggctggagtgcagtggcacgatctccactcactgcaacctcagcctctgggttcaagcaattctcctacctcagcctcccgagtagctgggattacaggcatgcaccagcatactcagctaatttttgtattttttagtagagacggggtttcgccatggtggccaggctggtctcgaactcctgacctctggtgatctgccagcctcggcctcccacagtgctgggattacaggcatgagcaccgcgcccgacctgtaccgcattttctttatgcaggattgagttttacaggatatcccaaagtttgtttttttaaatgacattttcttgctggggacagtcaagctacaaataaattaaatctaataattctgtgttccgctcttttcttcactgctacattttgaaacagaatatgatattttgatatttcaaagacattttctttgtgtaactttaatattgttaacaattctcataatgtcaatgacactgatatttccaaagagtccatcggactaataaacaagaaaatcagctcatagattattctggctgcggagtgaaaaatctagttaatttcttcctaagacaaacatctctgtaaaataactttcataggttaaaggtgacaatgaccctgaattcataaaatcagccaattaattgctgcacagtttccatttccatatcttatgtaatgtcatctccctgccagataagctgagcaacatttgggggagtacatgttattattaatctatccctgcttatggttattttaagagtaagtgatcaacgtactcaatgtacttgagtttatctttgaaagagagaggtaatgtaattagggagctactaagtgcctggtgaaatgtattggtcgattagacagattttaggatgttaataagaaaggaaggctgcctccaatgccatgacacaggggaagagtcaccaagtggttcagaggagattagaattcctctgacctgcctacttggtttagctgtgactgtttacttcttctaatgcaacacacgtattttaatccagttaaatctaaaccaaaaaaacaaatctgccattcataccccaagtaaaaatagtgatgtttctgtataatttatatgcttggagacagcgtttaataagtgttggcttgatttaaacaaacatcattatcaggtttgaacacatttagtacataaatatttggtatagaaaaatccgtttgttgcacaaaacactgccgtaagaaacagagttcaccgggcacggtggctcacgcctgtaatctcagcacttcgggaggctgaggcaggtggatcacctgaggtcaggagttcgagactagccttggccaacatggtgaaaccctgtctctactaaaaatacaaaaattagctggccatagtggcatgtgcctgtaatcccagctactcgggaggctgagacaggagaatagcttaaacctggaaggcagagtttgcagtgagccgagatcacgccactgcactccagcctgggacagaagagcgagactccatctcaaaaaaaaaaaaaaagaaaagaaaagaaaagaaaagaaaaaagaaaaagaaaagcaaagtaagaaaagaaaccgagttgactgcaggactttgtccaccaaacacagcttcatgaagtaaaatctgaaaacagggagcagcctatcaggtcaggtctatgtcttttcccttccctctgtggcagcatgcatttgcttcctgaattatattagccacaatcaggcatacacgaattacaacatgtgctctcagtaagaactggtctgatttacaagagaatttgaaatactttctctgcatttggggccaaagccctcactcaaacatgaagcatgctgtgtcacagcatccagaccttgtccagggtactacttacattattgttctgcaaaacccgcagtgccttgttgacattgttcagggcatgaactcttgtggatcctttttcttttggctgagaacaaaacaaaagagtgttcactgaccagcagagagaccgacaatctactagaaatgaaaccatttataatttcactattaagcttgaatattgtaaacgaacagagcctgtgaggcattaatataatgaatctaaatactttgcgctaattgtccttggcctggtacgtttttagcataaaccaaccactctaagaatggcaacactttttctttacaaagcctattttggtatgattgtttcttcattctatagcccagttggggattactgcatgaccaccaatgacagaaacatcagcatgcataaaaacattttctagtaagatagaaaaacaattcccaaactttttagaaaaatctaaaggagatttgactctagcaaaattatataatgccaaatagggttaaaggaaaccttttctgtgaagattaccttaattgtccttgtcactgaagctctaaacctcaatcactttggttccctaattttattctcaatcccaaaagttgtatcttatcctgtaatttttaaaccaacatctgcatagttcattgtaatatacaaattaactcatttattaagttgtagagttttagaaattctaccattatgataacctgttttatttactctcattttcatttcttttaccttactacaagcccttattagctattgcccagagaaatctaacctctttcccttctccactcactcaccatttttttcatccttccttcataccatcaacaatgacgttcctgaagtaagcccactgccaatgcaaaccacttgcaaagttctcacctaaacatttgggtgattataggtaacagttaagggcaagagctacaaagctgactgcctgggttcaattgtcagctctgctgtttttgtgctgtctggcctacataaaaaatttaatctccctgtataccagttttctcatctgttaaaaatggacttaatgaaaatattagcaagaggcatacacaagttacaacatgtgctctcaataacaactgctctgatttacaagagaattcgacatactttcttctctgcatttgaggtcaaagccctcactcaaacatgaagcatgctgtctcacaggatccagaccttgtccagggcactacttattgttcatattgctcaaaccattgtacatatggtttctggcagaattcagtgtgtcgatatgcataaagcactaagattggtgcttgtcacatagttggtccaacataaatattattgacttcgtagtatgtgccaagtactttgaatgcactacctttaatccccgccttgcaaggcagttagtttcatccctattgtacagaagtgaacctcaggttaaaatatctaatatatagattaccatataactaataattggtggagccaggacccaaacttttgtctgtgtctgtagagccccagtcttgcaaatttatttccttcttctctaactaccttgtgcatgcaccaaacaaatatctatatttctgtgtcttgcatttaactcctatactttccagcaaagctcctggtctttctcaagtagttcctcaccctagaactccttatcatttgcactgcctgctgaacaacccaaattaagctaaagccatcttactctccaaggtaacttgcctgatatcctttataacacagtattgacatcttgttcctttgatttcacaaaacattaaggctaaccttatgaaccagaatctccatttttacctcttagattttcctccaagaatgtcagaatgatgttggtttacattctgatatttctcccactttccaccaaaaagaggaaaaaaataagactttagatttaaaaaaaaaaaaaaaaaaaaaaaagcaacagccagacatttggggaggctgaggcaggtggctcattgagatcaggagctcaagaccagcctggccaacatggtgaaaccccatgtctactaaaaatacaaaacttagccaggcatgatggaacatgcctgtagtctcagctacttgggaggccgaggcaggaaaattgcttgaacccaggaggcagaggttgcagtgagccaagatcatgtcgctgactccagcctgggcgacagagtaagattccatcaaaataaaaaaaaaatacatgaaagaaaaacagcaaataaccaatcttcttgtgtatatatagattgacagtatacaagtttaatggtaattataggactttaaagttttgaaaataattactcaaatcagttctctgcctagtagttagaccaaagccacatatttcctttcaattatgtaattatatagtcacaagatttagcaaaattttcctttgtatcatattcaaacattaaatgtacacatgtgcatatgtattagaaccaaacatagtctactcttttaaaaagctgcagtttctgatcctgaagtgggaacttaaaatctgcccctattagagtctccttggggagtatttcttattttatgattgtaaggcaagtaccttccttttaaccctggggatgtcctgagccaataatccaaatgcagatgcttctgagtagaatactaaaatttctgttctatagtatacatgcctcccattaggagtagaagatatatctctacagaaactattagaattcaagacaaggcatagcgaattggagttctgggatcgggagcatttgttagaggtgattctgctttatgagaaaggcaaaatcctcagaccagggctgacagatctgtgattaggacaaacaatggtgaatggattctgttagtagcagtatctgaaattatgtaatctacactgccatgtgtaaatgtttggtgatttttccctaccactagcttaccttatactggccaatctcatggatattttgtttgatatttttttctttaatgctattactaattaggttcattttgtcttagcgtctatgtatgtatatgcataaatgcaaatcatgtggattttttaattttgccgaaattagtggttttttctttatatcaaatgggtagtgtgccaacatcataagtttagagaaaggcttatctcatatctgagtataaacacccaaatcatgcttatgaattacgaaaggatctgaaattcattatcttaaacattatgtatgaaatttgttaaccctgactaaattgctttgggtgatagatggattgactcagtcagggaaatgaccagaggattgcaacacaggagaagtgatcacgcagatacctggaagtgaagagacaacagcctcctaacagagggccaggacaagatgagtaagccataatctttgaaagatttttcacgaacatttggaagacactgggacttctgtattcggtaacaaagtaggactgacttcagaatacaggagaaacgagatacacagacacactgatttctgtacatatgctacgtatccatatatatgtaaattgttcacagtcataggagatgaattacacacaaatctatctctaactagtgaaattaagaccaagtttacatgatgacctcaaattggcgcccagcaaacagttcagctataaggtattaaatctgattttcccccttgactaaagttattatttcaatatgtcatcaagttgttcttctattagtacaagttcagacttcttgaaaaaaatggatccgttttagtattaatctcacatagctgaagataaaaaatgaaagcataggtatgtctcttctgtataggacttcagaatttaattgaggagggatgtcagtcatacatacactaaaaacaagacaaaaatgggccttctgtggaatttgggagggaaaaattagcaaaggtaatttgggaaaagctttactgaggtgaaatcaaggtttctggcagacagttggggtagacagaagtacaaaaagaaatacaggcaagtaaaataatacaggcaaaaacccagagatatctgacaatatataccgagaaaagagtggcttagcgttaagtgttacaggaggcaggctggggtagataggatttttgctaactgactttgaacgacagcttcagtttgtataatatgacaaaatctgtgtgtgtctgtgtgtgtatgtgcatgtgctggggagttgtaatgaagggcaaagataagagacgaaggctatgatttagcagaatttgataggtagaacagttatttatgactatagactgggggcttaaactctactttttagaatagcaatctaagacgattatttcagtcaggggatttcaatttgagttctttccccccccagtgtaagaccttgatcaacatgacttcactgatctgtaatcatgtatatcaatcatgtatcttcacaggaatgctctgaagttagacaagataatagttcaagaggaagtgatattttcatcacatatgctatcacgtattacactataatgcctgtaccttattttgctatcccacatgtataaactcatacaggttccttgtaaaataacttcaaaaatacacaaaagtacaaagataatttctcaagtcattatgtataaaagccttcattaagatatttgataagatagataccaagtagtaaaactgaataatatctattaatataaattgtattactgaaatttttactttttctgcaggcggtagagtatgccaaatgaaaatcatacgaggttgctttactaaggaataggtattgctgtttcaatcagtacctagtcattctactagatgtcataaaactatgttgtcagtttctggtctgaaattctactaagtttaaagttaactttcttaaaaataagtcacataccagtttttgccctgtcaggccttcgaggaggtctaggaggcgcctcccatcctgtaggtcactgaagaggttctcaatatgctgcttcccaaactgaaattaaaaaaaatacactcaatttaacaaagcacacttccaatgatacattttcacgattatccccttttgaaaactaaagctatatttaaggataattagtgtgcataattaatctgccgaagatgacggatgaaaaaaggaaagttcaaatgacaaaaaaaatttaaaaattttatcataggtcaagtctatttgaattagtttgaatagcaagagtaagagatttataccctaaatgatctaattaattcactgaaatgaatatagattctatgaaggagagaaaaaatacaggcatgatcaaggcagttacgggtaaagggaaaagtaaatacacaaagaagcaaaagaccacaatctacctgggtgggtacataaagtttaaccattcttggaatataccagtcagagtggttcgacatccttatcactcaaaacatgcttgctgtgcatacacattttgcatgctatgacctattctcatactggataactcaaattttaggaatatcgggtttaattaggtttgaaacaaccctgtgagagcttttcatctattttactcagttctttgctcaggaattatactaaggaaaaataatagtcaataaataatatttaacatttttaacgtaaatactcatgagacacactattaaatgagtggatttcataaccgttgtggcatttctgagattagcagtaacatacttaacctctaagtatctcatgtaagatgagtatgtggctctttgtcatgaaactagaatggggtaaagccaaaattatggctcagatctgtctaattctgggttcttgttctttcaatcttatgttgcttccttgtccttttataacctactatttgattatctttctaacatttgtctttcttttgtcatacttcaccaaatcgttttctgcttaaaaccctacaatcccctcatgaggtaattcccagctttttcatcacctatctggaaatccctaatttaatcagtcaaagacatattgagcatgaataaacctgagctaggtactgaatcatatgctagtacatcagacataggcccagaccctatagaacttagagtccagcaaagaaaatattcctaaaaggtactattacatagaagcattagaaaggactaaagaacatgtaacagtgggagctctcacaagccttgggatcaacaaatactttccaaaaaacgtcaggtgatgggtctaacattagcctttgggtgactgtgctctttacatacactccttggatcacatataaactttgaatttcacacaagtcaagaaaatccctggtttccaggcaaaagacatcccttaaacttccacgattaaaaacataggatttagactattcctacaaccaggtagccatgtcaatgacaagacctgtaaatgcccgggtacttcaagcagggaacaatgatacctgcggcaaccaaccagtccctgtgtgcccagctttgtgaatccagccacatatatacttagacaaaaattatgagttattcttttgaaattctactcaaatagatccattttcaaattccatgggaaaaagaacataacacaaaaccctaacatgctagaatttttaaagaatagctttactaggagggaggcagaacaagacggtcaaatacatggaaccttccagcaatcatctttcccgctaccgctgctatagaaacaccaaactgaacagatagccacacaagcaagcacctacataaaaaccaaaaatcaagtgagcaatcacagtacttgattttaatatcatatcaaggaaagaggcactgaagatggtaggaaagacagttacgaattgccaacaccacccctcccccatcccctggcagaggccatgtctcatgtagacgatctgtgtgcttgcaggagggagggcgcaggattgtgaaacgttgcattggaacccagtgctgccctgtcacagtgggaagcaacacagggcagaattcatcaagcgcacatagagggcacatttagaccagccctatccagggaggtatcacccatctcagcagttagaagctgagttccagctagtctcaccagtgtgagctcaagcactttggggtcctaaataaacttcaaagggagtctaggctacaaaaactgcaattcctgggcaagtcttggtgtcgtgctggactcgaagtcaggggacttggtgggcacacaacccagtaagacaccagtgcttgtaccaccccatcctctaacccctaacagtgcagctgacagctttgagagagactgcttcttccacttgaggagaggatagggacagtaaagatgacattgtcttgcaacttggacacaagctcaaccacagtaggataaggcatcaggcagagtcctgagaccccccattccaggccctggctcctgagtgacattcttaaatacacccagggccagaagggaacttgctaccttgaagagaagaatccagtcctggtagaattcgtcacctgctgactaaagagtccctgggtcctgaataagcagcagtagtagccaggcagtattcaccaagtcttgggtaagactcagagccatgctgtctttgggtgtggcccaatgcattcccaagtgtggtggccatggggatatactccttgtgcttttggaaaggagaggcaatagagtggactttgtcttgcagcttgggtactagctcaaccacagtcaggtagaccatcaagcaagctcctgggttctctgattgcaggccttggctcctggatggcatttctggactcacctggggcctgaggagaacccactgcacagaacggagagacccaggcctcgcagcgtttactcctagttaactaaaaagctcttgggccttgagtgaacatcagtggtagccaggcagtactcaccatgagcctgaggcagtggtagccatggggaaaaattcctctgcttatgaaatgggaaaggaagaatgggacaaactttgtattgtggcttgggtgccagctctgccacaatagaagagagcaccagatagattcataaagatgcaacttcaggccttggctcctagatggcaagcatcaaaagtcaaggataaagacaggatcctaaaagcagcaagagaaaagatacattccaaaaagcttaacaacaactagtaacaggcttctcagcagaaaacttacaggctaagacatgtcatgccatatttaaagtgctgaaggaaaagaccctttatgctaggatagtgcatccagtgaaaatctccttccaacaagaaagataaagaccttccaagacagaagctgtgggatttcatcaacaccagacctgttctacaagaaatgctaaagagaatttatcaactggaaagaagaggaccttaactagccagaaaaaccatctgaaggcacaaaactcagtaagtacagacaaacacaaactattgtaatactgtaattgtgatgtatgaactactcatatcttgaataagaagagtaaaaaaaggaagctttcagttaacaaataactctaataactttaagacatagacagtataatgagatataaacaaacaacaaaaagattaaaagagacgaagtttgagtttttaattagttttctctttgctttcttgtttatgcaaccagtgttgtctgtttgaaataatgggttatagtgtttgtaaacctcatggtagcctcaaataagaagatatactaagattcacaaaatttaaaaagcaagaaataaaagcatgccactagagaaaaatcgccttcactaaaaaggaagacaggatggaagagaaagccacaaaacaaccagaaaacaaaatggtaggaataagttcttaataataaaactgaacataaatgaaataaactctccaatcaaaacacagtgacagaaaaaaaaaaaaaaaaacaaacaacaacaacaacaacaaacaccaagactcaatctgttgcctacaagaaacacgcttcacctacaaagccagacttaaaattaagggatgtaaaaagatattccatgtcgatagcaaccaaaaaagaacaggagtagctattcttacatcaaacaaaatatatttcaagacaaactgtaagaagagacaaagatcaacatataataaaggaatcatttcagcaataagatataccaattgtaaatatatacgtaccgaacaccggagcacccagatatataaagcaacattattagacctaaagagagctggaaacctcaataccccactttcagccttggacgtcatcaggcaaaaagtcaactaggaaacattgaacttaatctgtactacagactaaatgtacctaataaatatttacagaacatttcaaccaacagctgcagagtgtacattcctctcatcaccacatggaggattctcaaggatgggccatatgttaggccacaaaacaagccttaaattcaaaaaattgaaatataaagtatcttatctgaccacagttgaatgaactgagaaatcagtaatgaggaattttgaaaattatacaaaacacaagggaattaatctatattctcttgaatgatcagtgggtcaatgaagaaattcataaggaagttataaaatttcttgaaacaaaactgtaaacacagcatactaaaacttgtgggctacagataaatcagtactagcaaagtttacagcaataagcacttgtatcaaaaaaaaaaaaaaaagagaaacaatacatcttaaagaactagaatagcaaaccaaactcaaaattagattgtgtcatgaagacatgcaaaacccgaacagaccaacaacaagtaatgagatcaaagatgtaaaaagtctcccagtgaagaaaagcccgagacctgatggcttcactgctgaatgttaccaaacattgaaacacctaatactcaaactattgtgaaaaagaggaggaggaagtacttctgaactcattctgtgaggccaatattagcctgacacgaaaaccagacagatatccagaaaacaaaactgcaggctattatctctgacaaatactgatacaaaaatcctcaacaaaatactagcaaaccaaattcaacacaacattaaaaaggtcattcgttataaccaagtggtatttgtcctagggatgccaagatgggtcaccatatgcaaaaaatcaatgtgatagatcgtatgaacagaatgaaggacaaaaaccatatcatttcaatagatgctgaaaaagcatttgataaaaattcaacatgccttcatgataaaaactctcaaaactgggtatagaagcagcataccttaacacagtaaaagccacatatgagaaacccacagctaatttcatactgaatggggaaaaactacaagacttttctctaagatctgtaacaaggatgcccactttcactactgttgtttaacatattactacaagtcctagctagatcaaagaaagaaacaaagggcatccagattgaaaaggaagaatcaaatgatccttgtttacaaaactaggaatcccattacctgacttcaaattatactacagagctatactaaccaaaaatgcatgctaatggcataaaaacagacacatagaccaatggaacagaatagagcccagacacaactccacagacctaaagtaaactcatttttaacaaaggtgccaagaacatacactgaagaaaagaccatcttttcaataaatggtgctgagaaaactggatatggatatgcaaaagaatgaaattagacccttatctctcgccatatacaaaagtatcaatctaagtggaacaaagacttaaatctaaggcctcaaactatgaaactactacaagaaatcattgggataaaatctccaagacactggtctaggcaaatatttcttgagcaataccctaccaagcacaagcaatcaaagcaaacatgcacaaatgagacatcaagttaaaaagcttctacacagcaaggaatacaatcaacaaagtgaagacacaacacacagagtaggagagaatactggccaactacccacctgacaaggaataaccaaaatctataaggggctcaaacaactccatagaaaaaaatatatataatcatctgattgaaagaagggcaaaaatttgaatagagatttctcaagagatgacacaaatgtcaaagaggaatatgaaaaggttgtcactatcattgatcagagaaatgtaaatcaaaactacaatgaggtatcatctcaccccagttaaaatggcttatatccaacagacaggcaacatcaatgctgatgcggctgtgtggaaaagggaaccttggtacatcgttgttggggatgtaaagtagtagaaccactgtgaagaactgtttgaggttcttcaaaaaaactgaaaacagaactaccatataatccagcaatcctactgccgggtatatacccaaaagaaaggaaatcagtttgtcaaagaaatatctgcaccctcatgtttattgcaaccctattcacaatagccaagatttggaagcaatccaagtatccattaacaaatgaatggataaagaaaatgtggtacatatatacgtagtggagtactactcagtcataaaaaaaaatgagacgctgtcatttgcaacaacgtggatggaactggaatacattgtattaagtgaaataagccaggcacaaaaacaaactttgcatgggctcactcatatgcagtaactaaaaattaaagcaattgaactcatggagacagagagtagaatgatgtttaccagagtgtagtatgggtagttggggacaggaggagtgggaatgtttagtgggtacaaaaatctagttagaatgagtaagatctatttggcaacacaagagggtgattacagtcaacaatttactgtacatttaagaatttgggccaggcacggtggctcacgcctgtaatcccaacactttgggaggccgaggcaggcggatcatgaggtcaggagatcgagaccatcctggctaacacagtgaaaccccgtctctactaaaaatacaaaaaattaggtgggcttggtggcgggcacctgcagtcccagctacttgggaggctgaggcaggagaacggcgtgaacccgggaggcggagcttgcaatgagcccagatagcatcactgcactccaccctgggtgacagagcaagactgcgtctcaaaaaaaaaaaaaaatttgaagtggaatgtttgtggcacaaagaaaggatacattcttgaggtgacagatacttcacttaccctgatatgattatgcttcgcatgcctgtatcaatatatctatttaccccctaaatatactatgtatccataaatttaatctaaaacaaagcaactttactatacataatatacacataaatcttaaaacagtgccattttaatgaaactttaaggaaagctctctagtaataagaaaataaatttacactttctaatagtgctgccaagaacttcatatctaacctggaataatttggtattttgagtgtaataatttgtttttcaaattgaatgaaggtatacaatgccattaaaatgatgtgtttttttccctcctttggccaggagcaaaatttcacacttatctgagcaaagcatgacttttaaactcatcaaaaaataatcttatgcactgcaatgtgtccattgttgaagaaaatatagttaactgttaactgacagagatacttgtttttatgaaaagaaaaaatccagggtagaaagttgaagtctgtcagaccaagaagtatgtgcgtgataaactgctgtttattcaaaaagaggagcagagactgggaaaggtgagagaagtcttggagtacagaataaaacatgaatcccaaagccatcaggatcatatagcatccaagacacaaggactacgtttgggtttggagacaaagtctaggcaaaggtcaaaaacgcagacagaatcttgctttgtgggccaaacttaaatacatagaccaaggtcttttataagtcttcttttaaaactggaggtaaccaaaatggagagggagtaaaggattataggtcaggtaggggattccatgtacacctagctggggcaccgagagagagaaagcagtgaggtgatagagaaacagttcctgctatcgtattattttcgaaactcacagagtcaatgatatattaaagtatcacaattgaaatccaatttctattagtcatattcaccatattctctaatagagtgcttctcagaatattctaccagagcatccttccaggaaatgaaattgaaggaatttaccctggagtctggcagtataaattacacagtgcctgcaggttttaaatttctttgaaagcatatactttatgctaaaaattcctagagattttgccttcttcttttaatatatgcttgtttcaacgtaaaactatttatttatcatttattttttgagacagagtctcgctctgttgccaggctggagtgcagtggcgcaatcttggctcactgcaacctccgcctcccaggttcaagtgattctcctgcctcagcctcccaagtagctgggactacaggcatgtgtcatcacgtccagctcagttttgtatttttagtagagacggggtttcactatgttggtcaggcttgtctccatctcttgaccttgtgatccgcctccctcagcttcccaaagtactgggattacaggcatgagccatcacacctggacttatgtaaaagtaattttaagtacttttgagtaaaaatctcccccacccccgttcccacggtctgatgtggttttttttttagtgaaatgtgctacatttagcctgtaactttatagacctttcggtgctcagttttattctccctgtagtatgaataccccaggtaaaatctaacatactatttctcttggatggttctaattttcctgcctgcaacttactctatagaattatagatactatagcaaaagtaacccaagtttcagaagcagaaatagctaacttctgaactcaggtctctcactcactcactagctgtgttatcttgggcaagtgacagcctttctgaggcacaatttattcactattagaatggggctcaaattattactccagagcactcccgtgaggttcaactgcaacacataggaacgttatacagatttggcaaatcgtatgcactcaataaatatagattgatttttatgtttcattttaacactatttgtctgcatctctttctttgaccaaattctaggtgtaaaaacgtttaactcggccaggtgcagtggctcacacctgtaatcctagcactttgggacgctgaggcaggtggctcacttaaggtcaggagttcgagaccagcctggccaacatggtcaaaccatgtctctactaaaaatacaagaattagctgggcgtggtggcacacacctgtgatcccaactactcgagaggctgaggcaggagaatcgctagaactaggaaggtggaggttgcagtgagccgagatcgtgccactgcactccggcctttgtgacgaagcaagatctcacacacacacacacacacacacacacacacacacacacacacacacacaagttaaagtcttttcgataatataaaaatattatattagaaagtgcagaatacatgtaaaatgttttctattagtttggcatccctgtgggagtgcaagtcaataggggaaggcattattccctatacaattactaaaactggtgaatgcagatggtacagaggatgcacttagaaacttgctttttcctcccttttcttgttcttttgactatttttaagtattcttttgttgttctcccctttcatcttcaacatacaccatgtctttgttgcaggtggcattttatatcctaagaacaatattttttctttaaaattcaacctttaatggcttccttttcaagtgtatgagaactattttgtgaagcacacaaaacatgaattcctccttgggccaggcgaccctgtagctctctgtcttcagttcattttatgactaagatttcccttatcaagtgaactgagtggatatctgatattactcagtttaatgtatctgcatatatattgtctttgttaacccaaaccacaacacgaaaggacctaaaaacgagacagtattccttccaaatcctttttagtatgaaataaagaaatacggaagcacaaacagtgttcaaaaagaaacacagataggtaggttgacaagtggcataaataaagtgaaccaaatcaaagtggaacaaatcaaagtaaaaaaatttgagaaaggaaatgcatttgtgaaggtgtttaagtggtttctgattcttcagagttgtattggtcttttaacctgaaaatccaaagggatcaatacgtttcagtagaaagtaaagaacacagggataatttagcatgaccttctgattacaaaaaggacaagccatggacataactgtcgctaagaaagtcaagatacttctgcaattacaaatccctagacattggaaacaccaaaaatatcgcaaataccacaaagaattgcaaaactggggattcaaaacttactgaagaacgctgctgaccagctcccagaaaaataaggcaacccattttcatgtaaataggaagctttccgagttgattttttttttgttttcttaaatatgagttggaaaaggtattgtataataaagcagtattctgttgcggaataatatacatagaggaaagtacacgtcttaagtgtacagctcaatgaattgtcacaaaccgaacatatttatattaccagcatcgagatttaagaaacagaatatgatcaacaccctagcagcttcctcacaccccctatgtggaagctcccctcaagaatggccactatgacgacttgtggcatcataggttagttttctcttgaaaggagtcacctaaagatagaaaaatgctggttttgtattttgagttagaatactagtgactgaaatacattagatttatgcagagggaatttagaaaaaagtcacactgataaaatatgctttggaaaacacgggggaatggtatgatgccatgaataagaatgttgactgtacacccagaatgccttgggttcaactcccagctctgcagtgtgatcttgggcaagtaacttctccgtgccttactcttttcatctatagaaagagcatgtatcattacctatgttgtggtgatattgcaaagatttaagtgaacttagtatggcactttgtaagatatattctgtaagtgttagctatcacacgtttattccaaactttctaagccaaataatccatatcgtctataactttccttgtaatgttggcctcaaagtaacagaagggaccaacttcaaaatatgagaattaaaagggttaataaatgtaagatgtctggtatggtacctagcatagaaaatgctcaataaaaacattaaataaattacattccctcctgttaaatgttatcacctggaggtggagaatgacactctcctttgaaatttatatggccatagcaggactttggtaatctgagaagagtttaataagggactgtttataaaaatgagggaaggtataatgaaaccactggaactagtaatagagaagtgtcactactactcttagactcctaagaatgaaaagaaggagagtggtttctagttactacatagagagagaactgagaagagaagattatctgacaggagctttgatattgggtgatggaatttctttcctctctccctctcttaccaaggctctcattggccaaatccaactagtagccagagggcaaaggagcctgttgatgtagtccacagacatcagcctcccaaggaagacaaaagtggagagtagggccaaagaaataagccaaagacattcaccaccctagacatggaagcaaatttcctttgagccaaggagatcaatgccagggatgtccatatcagaaaataaatgaaggcctacgtgttacttcccatgcctcatatttctatctctggtgatgtcattgtaaggaatcatatgtatcactggaacaccgtcgtcttctttaatagtgatatcaaaatactggaatgttttgtggaccttagcagataaaatcagtaggtatttattcattattccttagcgtcaaatacttgtagagacttctctctaccaaaaaaagcacgaaaatctggctatgaagatcatcaagaaaaagccaagttattccttgcagctagcaagtgttcaagagcaaagctacaaaatacaagtttttataatctctccagatataaaatgttatttggcattttataaagcatcttaactagaacccaatatgtatgttactctattaagtacactagaaatgattcaaacagatgtgcattcgaactttaaataggaaaccacaccatcgttaatggaaatcaagttgttatatgtaagtgggatgttatgaacccagaagtatgcttaacaaaaagtcagcatgattcattgtctgatcaggtctatccttaacatgttttgtaataaaactaacttctaaagctaggtctcaattgttttatctttaagttaggtcagtactcattcattttaccaggtattctaaaggaaatattaataaaattatggtaaatgctttatcttatatttttatgtattaatgtaattcacaaagttattttaaaatttgtggaatgattacaatccatgattatactaattacaccacctttaaatatcccctataaaattgaacattctgaaagttaaacccagttttttgttgttgttgagactctgtcaccttggctggagtgtagtggcgtgatcttggctcactgcaacctccgcctcccaggttcaagcgattctcctgcctccgcgtccctagtagctgggattacaggcgcgagccactacgcttggctaatttttttatatttttagtagagacggggtttcaccttgttagccaggctggtctcgacctcctgacctcgtgatccacctgcctcagcctcccaaagtgctgagatttacaggcatgagccactgcaccaggcctaaatccagtttttcttttgattcacatagatacatgatttgcatttgagatagccagtgatggaaatgaaggctaattacaatctatcccaatggttgcttttctgacagaaacggtatggtacaaggttggcaagatgaagcactttgtttcaaagcatgcaaataacactgattcttcaaaaaagaaatctataggctaggcgcagtggctcatgcctgtaaccccagtactttgggaggccgagaagggcagatcacttgaagccaggagtttgagaccagcctggccaacgtggcgaaactccacctttactaaaaatacaaaagttagctgggcatggtggcacgcgcctgaagtcccagctacttgggaggctaaggtgggagagaatctgggaggcagaggttgcagtgagccaagattgcaccactgcactccagcctgggtggcagagtgagactccgtctcaaaaaaaaaaaaaaaagattgtgtttatacacacacacacacacacacacacacacacacacacaaatacacacatataccatgacataatggaatggctcactagacaaacatctatgagtactcagttccagggaaattgcagagaagaaaagtgatatttaggcttcagatctagtagaggaaacattatggacaaagggcatccaaagatgactttaattaatgaatgtaaaacgtatttattaccattcttataatttctcaattaccctacggtgcagttgtgtatggacaatataggtgacaagacacagcttcttcctaattattcccatcctccacctactgggaagtcatccttggtttattcattctttcttcttccatgcctgtaagggtctgtctacaggaagttccaaatcaaagaaattggaaacacagaaaagataaatgtcacataggatacaatatttaaagaagatcttctgtcaaaagtcacagaggataaaatatttaaaggagaacgtctgtcactgctatgctttatttccttttagtggtccaactttatgcaatttccaattctgaagtcaaatattgtcaaatattacaatttttatatgactctacctcatgtatcagaaagatgcgagttacacacatcgactggtttatgtcagcgctacttctgtgtactttttgtgggttgttttaatgttcacagtcacccccattttacaactgatgaaacagacacaatataagtaacttgaataaggtcacacagcaagtaagtgctagatactaatttggacttaggcagtgtatctacagatctctacaccattctttactttgcaactgctgtttaagctgggcttgactatcatcacattcaggggcaagggttaggtgagttttacttgagcctttacgtcatcttttctacaaagatagtttaatatatcttttctttcttctatcatttccaaaaggtcagatacagttatatagcctgccaataaaattgctcctaattgtaggtcccatttgtaatggaaagatagtaacagtgataattctacatatatacattaggaaaattcttcaaagtcccaaattcctattgttatatcatttgacatcgggggtttcattaactcctcaggactccagtgtgctcagcagactcaattactaaatactattttagagcacactgcaaattgttcgaatgtataattcactctaatgtatttgaaaaatgtggctttttatattaactaaagaagaaatatcattcaacaaaaacttaaggctatataaatcaaaatataagaaatataatccttgaagttgataaggattaaatgaggtagtagtaaacagaagaaaaagtttaactagggcatttagtgtagccatttcttaagatccactgaaaagtgccagttccttacttgaaagtcttccatgtgagattcggtgtagttgtaagttaaataatatagtatctggaagcaaataggcctttatttattacagttctataatttaaattttgccagttgtgtgaacactgataaattacatagcacttggcttattttccttatgtgtcagacgagggggatagtcattcaactaaatgtaaccagtattatgcatcatactgtcctaagaaaaatgggaagataaaagataaaaacatactgccactgttttcacagcttttgtaatagcctaggaaggaaatatacatttaagcgaatataattatagcatggtgttataatcctattaatagtgatttttttgtcgtaagtatggtgctggcacaaataaaagatatcttcactggagagaacaacagagtgaaaatccctgaatagaatatacaaggttgaacaggttatcaacaggtagaagtgtaaagggaagataaagtcaagcagaggaaacttcacatgctaaggatcagatgaaatagacgcactgttcaaggaactataagccacttcttggaacgtaagtggacggatggaacatgagactagagaggtacaagacaccccatccgagtgtaccgacttgattaaccacccaaagctgcttaggcaaatgtctgcttgtcttttcttttcaccctttcaaacataactaattttgagaagctcttaccatgttttgcattttttaattcatattttgactgacactttaacatagtattgtttaggaaaaaccaatattggcactgtttaccaattatttgcatgcaaaaatatttggcaaggaagccatactgtccaggagcaactgctgtaaatggtaagttaactacaaaattgggcctagtatttcatcctttcctgaatccataccctttgcaatgtagcattgctgttcttctcatgaaaagttggtatctatttccctgcttcttaaatctgggttggcatttgactcattttgaccaacagagtgcaattgaagtgctggcatttcctctcccaaatgtagacctcaaaagggcttgaacacttttgctctcttgttcatgcctctgcatttaccgtaagagcacatcagagctagacagcaggaggatgagacaagtggaaccgagtcaagttgccctagttgtcccagatgaagttttcccagactagcagacagccagacatttcgcagagctgagctgagatcagcaaagccccttagccaacccccagctaactagagacacacgagtaatcctagcagtaaggtgaagaacttcctggctaacatatgtatttgaaatagtatgttggttgttttaacctactgagtttcaaggtggcttattacacagcaatagctaatatgtgtacatacatatgaatatttgtttctacacagaagatgtctgaaaaattaagccacattataaagatatttataaaatatttttaaaagagccctaggagtttttatgagaaatatcaagctagaaattattttactgctgaaattgaatatgggcaaaagtcagtttctagagatctgactcatgtgctattagaaaagaacacagtcattatattccatgcagttcctccaatgcaatcttgcaaaaaagaattaacgaagcaatagttttgtcagtttcatagaaattttttaaatacagtgtcaaccttaatatatacatacacacacttttttttgggggggggtgggggggtggggggggggggacagagtttcactctttcgcccagcctgcagcgcagtggtgtggtctcagctcactgcaacctccgtctcccagtgtcaagcgattctcctgcctcagccttccaagtagctgggattacaggcgcatgccaccacgcccagctgatttttgtatttttttagtagaaacagggtttcaccacattggccaggccagtctcaaactcctgacctcgtgatccgcccacctcggcctcccaaagtgctgggattataggcctgaaccaccgtacccggccaactttcaaatatttctaaagctacctttcgtaagacttagtgtttaactcttctgttgtagccactgtattgtaaatgcaactaaggttgtattccttgcccaatatgttcatttgacgttcaattggagaagttaaaaaaaaaaaaaagttgactttatttttctcccatttgctagatttttactgtcactttagataaaaagtgtgtttatcttgttttcttcattataagctataatttccagtggtttattcagacatttccaaaacaaaaatagtaaatcaaaaatagttccctgtgaactaaaactgtcacctttagttagtgtttctagaaaaatgcattttaaaataaagttgaataagagccaaaggaaagtagagttgacaatttttttcttacaaagctcaaagaaaaaatttaaaattgccctatgagaaaatcttaataggtacctgacatttcaataggaaaaattagttataactgcttaaatagaagtttttaccaagagctttattacataactacaaaaggtacctaattcagtgattcatctttatcagcaaacatttgctaattgtaaacaatcctgtacaaaatatttttatttcaaagaggtagcaactttccaaaaatattgaaccaaaaggaaattgaaatgaccttggtttaaaatatcattatcagcttgaaaagtggaaactatcaaatagttaaccaactttttaaaagattggtgctcactcacctggctgaatgacctacctctttgaaccttaaatttaaataatggctcggtccacattaaccttctcttgattttagactgtaatatccaatatgggaatttaagcaaaaacttaaagttacatcaaaaatggaaaaatatggagagaggccaagatgaccaactaggaacagctgcagtcagaggctcccactgagaagaaccaaaaccgtgagtgaatcctgcaccagcaacagaggtgtccaggttctctcactgggactgactaggcagttggcatgagagcgcaaggaaaagcagggtggtgccatggcccacctgggagccaaacgcgacaagggaagctcccactcccagccaagggaggtagtgagtgattgtcctaccctgcctgggaaatctttctttttccacagatctgtgcaacccgcagatcaggagatcccacttgcgagcccatgccaacagggccttgggtctcaaaacacagctgtgcagattctcgcaggccactcggatggagacgactccttaagactgctcagtttccgggggcgggggcggccatcatcactgcagctgcctgttacagcaaatgactgagctctcccggggaggggcggcatctaagagaactgccacctaagagaactgagctgctgtggggaggggcagcagccatcacggtggctaccggcttactgagaggactgagctcctgtagggagggcagcagccatcactgcagctccagtccaccatttttccccttcaggtttgagggagactggacagtttgaacccaggaggaattccctgcagtacagcacaccagctatggcaaataatggccagattgcctcattaggccggactctgacccatccctcctcactgggcagggcctgcttgcaggaattccagtaactccagccaggggtttagggaaagaactccgattcccctggacctgagcccctagggggaggggtggccatggtctccgcagatcagcggacttagtctttaccctgctggctctaaagaatccgggaagcccagacaagtgggattcccccaggacagcaaaccccctcgaccaaggggcagccagagtgcttccttaagtgggtcctggatcccgtgcaccctgactgggtgagacccacccccaacagcagtcgctagacaccttatacaggaaggttcctgctggcatctggtcagtgaccctcagggacagagatactagaggaaggagcaggcagccatctttgctgttctgcagcctccttaggtgacatttccaagtgcagaagggacccaggtgaatggggtctggagcgaacccccaacaaactgcagcagccctatagaagagggacctgttaaaaaagcaaacagaaagcaacaacaacagcatcaacaaaaaaaatcccaattaaaaccccatccaaaggtcagcagcctccaagattgaaactagacaaactcatgaagatgagaatcaaaaaacaaaaacactgaaaactcaaaaagccagagtgcctcttctcctgcaagtgattgcaactcctctccagcaagggcacagaagtggacagaggctgagacggctgaattgacagaagtaggcttcagaagatgagtaataacgaactttactgagctaaaggagcatggtctaacccaatgcaaagaagttaagagccatgataaaacattacaggagctgttaacaagaattatcagtctagagagtaacataaatgacccaagggagctgaaaaaacacaagaacttcacaatgctaccgcaagtatcaataaccaaatagaccaagcagaagaatgaatttcagagcttgaagattatcttgctgaaataacaccagcagacaagattagagaaaaaagaatgcaaaggaatgaatagacgcagaaaagtcttgataaaattcaacatcctttcatgttaaaaaccttcagtagattaggtattgatggaacatgtctctaaataagagctatttatgacaaacctacagccaatatcatactagatgggcaaaaactggctgtaggttttggtatgacaaacccttgaaaaccagcacaagacaaggatgccctctcttaccattcctattcaacactgtattggaatttctggccagggcaatcaggcaagagaaagaaatcaaggataaataggaagagaggaagtcaaactgtctcttctgtgtatctagaaaactccatcgtctcaccccaaaatctccttaagctggcaagcaaattcagcaaagtctcaggatacaaaaatcaatgtgtaaaaatcacaagcattcctacaacaatagacagagagccaaatcatgtatgaactcccatttacaatggctacaaagagaataaagtaagtaggaatacagctaacaggctaagtgcaccacctcttcaaggagagctacaaaccactgctcaaggaactaagaggacacaaacaaatggaagaacattccatgctcatggatagaatcaatactgtgaaaatggccatactgtataatttatagattcaatgctattcccatttatctaccattgacattattcacagaattagaaaaaaagaaaactgttttaaaattcatacagaaccaaaaaggagcccatatagccaagacaatcctaagcaaaaataacaaagctagaagcctaatgctacctgacttcagactatactacccaaaacatcatggtactggtagaaaaacagacacatagaccaatggaacagaaccaacatcttggaaataagatcacacatctaatacccaaccaactgatgtttgacaaacctgacaaaaacaagcaatggggaaaggattccctatttaataaatggtgctgggaagactggctagccatattcagaaaactgaaactggacaccttccttacaccttatacaaaaattaactcaagatggattaaagacttaaacacaaaacccactaactataaaaaccctgtaagaaaatctaagcaataccattcaggatatatgcacaggcaaagattttgatttcctgacaaaaacatcagtcaattgcaacaaaactaaaaattaacaactgagatagaactaaaaggcttctgtacagcaaaaaaaaaaaaaaaaaaaaaaaaaaaaaaccacaaaacccatcatcagaatgaacaggcaaactacagaatttttgcaatctatttaccattaacaaaacattcttcccctgcatccttgccgtaagcttcgacctcagccttggatagacccaccctcctccaacctgcaatcttttcccgtgttttttttctcttaatcttggtctatttttcctctctgcttcaccaacagttcatctccctattctttcttcagtgtcttctgaaaccctagaataatttgaatggttgtctttatgccctcagtctcagctattccataacaaactctccttacttagaatttgatcttcatgtttgtttacctgcaatggtaaacaggcttaaggcttgtctccttcccccgccctccccatacttaagatcaagtgggaggtttctattttaacatattaactgatgccttccctcattcttggaagctatatatgtgtacttcctcaagcgtgctactataaaaatacaaggaaagagacatcaaggatcaaataatgtgtttctcagtaattccctggaatctattgataagattagagccctgcattgaaaaatccttagtatattgagcaccaatgacattatctatctcgtaaataagagctgggaagattgtgtaagatacagtttgactcattccaaaggaaatgtttttcaacttccagctgttcaactggaacaagaacagtattgtaatggattatggtaagacacagtcgttgttatgagcttctgacaaagtactgtatcattccactcccactctgagactaagtttcagaaaccctatataggtttagaagaattccagagttaagatgtaccttgcttgctagaatatggtttgggaggtcaaatccactcagtcaccccctccctccccatcataacactagcacagtaggttaaggcatgaatgagtcaggtgtcaaagcaggcgagactgaaagtatgcttctgggcactccaggcatgattaaattggtatgaaaaggacacgagagaggacatgatatccaagggcttgactggatcccagtcatcgttggtggtgacatggggatagagaccaacagactgaatgattacttgtatcagcagaagacttcaagagaggatgactataggcttgtcatccccgatttctggatgtgacttaagtccctttaaatttaaaggttgctaatgccatcatgaccaactaccattgaacattttaactgatgctctgacctcacagctttttgacctgctaagctgcaatgactttgatcaatttgcgtccatgttcatggccagttcatgctttctcacctacctcgaaccatcctaccccatggatcacacacagtgaattgctcacttaaaccacagtatactgttcttgaaacttctgtcccctttttaaaattcaagtattatctacaatgtgacagatatcacatgaggttagattgaataatgatttagtttctgcatttctggagcttactgtctcaagaagatgaacaacaaataagagatgacaacattttacatgctaaggtagaaataaagtcaactgaaaaagaattttaaggctaagctataggaagccctttctgaagagatacaattcaaggtatgatcttaaaaaggagattttataaaaagggaagaattacagatagcaggcacaagatgcacaaagggaagtaggggaagtggatgctaaatgaagttagtgggcaaagaaggataaggggtaagccacagtagagatgttaaactaaatgtaatagagatgcttttacaggctttgggtaggagagatatgatctagtttgtgttttataaagatctctatggctcctgtcagaagacatcaaggagggcaagagaagcaatggaagactccagtgcctcatgcattcattttaaaactcttagtggtggctaatcttatttaaactaatcttagtggtggctaccacctcaccatcaggtaaatctccttctctcactcactgttgatcataattgctttatcaattgttagtcctgattttacccagcctccgattcttttagttccctttttgattgctatgcaattcctgaagtggtcatataacccaggcctgtaggtcctcaggacacatggcatttcatcaccgaccctttcctgctttgctcaaatgtcaggggaataagcccccctcctccttttaaaagctgacccctaaatatgtgcttttgagataattggctaccaacatctctaggatttaattctcttccctcctcgttcacatacacacaggcatctagatatggcaggcagtaggcattagagtgagagagcagacattgaagctacactcaggcctgtttctcagactttagtatatattagaaccacctggatgagcccgttatgacatgcattgcctgttaattctgatccaagtgtacagaggactacaattttgaggaaataattctaggctcagctttaccactgattaagtagccatgagtacatcaaggcacatttctgagcattcatttcttatatgaaaatgaagtaggttacagtggttattctctaaggatactctcagcactcacagtcccctattctgtgtctagaatctaaataaggctaggaaaaaatgcaaacataaaatgataacattgtaaaagctaagaatagttactaaaaattagccaaaaccctttgcttctccaaagtcgaataaaaatcaagtaatgacatgttatgtataattgccatcaaataaaaggaaaggaattttatcttagcctaagctaagggtaagattttcaatctgaagtccacagggacaagaccaagaacaggaacctaacaagtcctttgcaatgatctgaataatgaaacatcccttagatcagagtttctcaacatttgtttgcacatgaaacctctgaagatgttagtcaagtgcagactcgtgtgaggtctaggatagcgcctgaaaatgtacatttctaacaaaacctcaactggtgctcctagattgcagaccataatttgagttgcaaggccttaagtctatccctcacagcagctgtcataccaaattttcactttaacaacaatgaaaaccttaacagaaagtgtttggcactttcacaaaagaacagataagcttttcatgtctttttcttaaatctgtgttcacccattgttgagggtagaacattgcgacaagttcatttttacagagagccaaagtaagattccccaaggaagttttctgatattctctattgatacaaagattgagcttagaaaatgtagaagaatgaacggtcagcatgagccttgaactctggctaccatcaattgtttcctgccaagatgcatctcttttctttcctaaaaactgccagttttctctctcgcctggcttgtttgtgcaaggatcttctttcttctgcccttctcagctagagtcactgacacactctcctcctgtgagatatgcatcactcaataccatggtaggaggaggaaatttacagcagttatgatggactagaaatggccacaaaattatttgacacttctttcatcaagaggcagcatctaattctccccttaaagctcggatttgtcttagcaacttgtctgccaagtagaatgcaacgaatatgatgttataggtcttccaagattagatcattattagtaacttttagcctctttatgggtttcttagaatactcactctgggagccctaagatgccatgcataaaaactgactaccctgaaaccaccatgctgtagaagacatctacaagtcctctggttgacagtccctgctgaactgagcctttcagccattctcacaatggcattaagcattaagtgaatctgtcttgaaccctccagaccagcacatccactagctgaattctgccaagtgatgtcaactgacaccacacagagtagaaaaatcaataagctgaacacggctgaattcctgattcacaaaatcagataaaaagataaaagagatgttattttaagccactgtacttggggtgttttgttacatagtaatagaaaaccagaagagtatcctaagctccctctggaatggaggctctgccttgaatcacagccctctcgatcgagaccttgatacatgtccctcttcatcgactcttgaactctttctggttccctgatttactattgcctatgtttctatttaacagattacaccctgtctcccagcactcagtctcttcttagttacacctgaatttccccagtgcctgtcctgcctagtctgtattttctccttttcctccagcctacactgctataaccttaggatactttcaacctgctgtgagaaactctatgcaaagtgtttccatgataattttctgctcttttcccttctgtagggagatatgttttggctatctctaccagtttatctacttctaatttcactttaatccagtgccaggcccggttgtaagcaccgaagaataaatgaatgactattggataagtgaattagtgagtgaatgaataaataaatacatcaatgcatttataggttatggtctactactccactgaaattgttactttaaaattagtcaaagcaaccagaaaaccgaatggtcttttctcagaccccaagtaaatttcaattcaatcactgcctttggtcaatgtagtcacctccttaaaaactgtttttcttgctgcttctgtgaccagacactttacagtttcctgtgacttctcctaacacttctttgctggcttctctatatctgcacgtatttaaatgtgaattctccaagacttggttttgggttcctttttaactgtgtataatatccttttgccgtatcatctgcccccatggcttaaactccatattgattacccccaaaccattttctttagttgtggtatcttgcctatgatactttctcactgctacacctatcaaacacacactgatttccctcctcagatccagacatattttccggagattattggatatcccatcaatacatcaaagacaatatatcccaaatacaaatcacttccccatcatagttttgcttatttctatttctaaccatatccaatgataccaccatcctctcaatttttcagccctaagacataagttattttcacctcattcttgccacatcctttaattacatcaatactgatatccctgttgtctctagatacaaaatgtcagttataataaactctaaaatggtttcttcacctataatcctcaaatcttgacagttatccaatttagtctatgtagtacaactagttattttcctaaaccgttcttgtaagtactccaaccacagttgccccctagtgctttcttattctgtagattgtatttttgtgttctagccttccactccaccaacacctttcttcaaggctctgtttgaatgaattcttgattcccatgtgccttgccattcctttataaccaactccaaaaaaagtccctcctgatcttgcggtctctcggtcatttgttcatgtcccttaatgacatattgtcattatctgacttgaagttgttgtaggtttcctcactactttatgagcccctggctgaaagatatttttttttaatcccctactaaaactagcattgtctattgcacatagtgaatgttccgtgtttcttaaatttggagctgttgaacagtttcagttttcagctacattcactttttgactgagttgtaccataggtgacactaatctgtgccaaatggggcacatttaaactacttacactattactttaatgttttcattgaacgcaggaatctttgtagcctctaggtacatttaaactttaagataaaaattatattctgtcaaatgatttataatcaataccattgccaattaaaatcaaataatagacacagaagtgcctcaaagcttcaactaagatagacacaaaggggtgccagtggataacagtgttatttcataatcacagcttcccttttccctctagcaattattctgatgcagaatcagtcttaagaggtttctgcagctagatgtaaacaaagaagtatcattacaaaactcacttgactacacttctgacaccctggttggggaaatgtatatggattgatatgtctgactgacaagaactcaaaatttaaatgatcccttgtccaagagccctgtggttatcatttagaattcatctgcacaagtcattaagtatactctttggaaaactattttgttccggaaaaatgtaaagtcaagaagcaggaatgctaacatttgaaaaaagcttctttaataatgctataattctgaactttttgtttatattagaaaatattttttcttttaactctagctatagtacaattagagatgtttcaaaattattcaggtaagtgcttaattgggtccacgtaatcttctgaaagttagccctttagaggttatagccaaaaaatcgtgttttatccagatccactaagattccattaacacttctgcgtgcccacctccttggcttttgtggtctttgcttctcaaaacttctgtatctacatctctttagatgactgtcttcaggctagtaaagctgctttgccaacaaaaacagagatccggaagtgccttggtgtttatgtcaccttagggtagtcttaaggcaatgactggtgactactggaatacaaaagcccagctccttctgtatcaagttgcaacaagctgaagcatagtttaggcccaggttttcctgcagaaccagactgaggctggcactttgcctgcgattgctccttgcatgatttcttccccattcctattctacttctcttgctcacctacttgccatccctgagaacatttccttaattaaactactttcatgcaaattctcctctccacatgggctttaccaaaacccaacctgaaacataagcattcctctaattacagtaataaaggcatcagatttctatttgaaaatactaggaatgggccgggcgcggtggctcacgcctgtaatcccagcactttgggaggccgaggagggcggatcacgaggtcaggagatcaagaccatcctggctaacacggtgaaaccccatctctctctaataaaaagacaaaaattagccgggtgtagtggcgggcgcctgtagtcccagctactcgggaggctaaggcaggagaatggcatgaacctgggaggcggagcttgcagtgagccgagattgctccactgcaccccagcctgggcgacagagtgagactacgtctcaaaaataataaaaataatatggtgttaaactgattaatctttaacttcgacagaatgttagagttcaaacctgtagctctatggaggttttgattaccattataatccattaacacaatatgttactaagatagcatttcagagcacagtatgattttcttgtagctatactacaaaactacaatactacagtatctgtattactttagaaaatctctaaaaaagttgtgaattatactgccaatggtttgattagatagaatcttactgatttttaaataatatcaaatttttccatctctaatcatgaaaagagtggtgaggtagggcaggataaatcgtaatattggggccaggtgcaatggctcatgcctgtaagcccaacactttgggaggctgaggcaggtggatcacgaggtcaggagttcgagaccagcctgaccgagatggagaaaccccatctctattaaaaacacaaaaattagccgggcacagtggcaggtacctgtaatcccagctactggggaggctgaggcaggagagttgcttgaacccgggaggcggaggttgcattgagttgagacagcaccactgcactctagcctaggcgacagaccaagactacgtctcaaaaaaaaaacaaaaaacaaaaaacaaacaaaaaaaaaacaactaatatttgtatattaatataaactcctgaatccctcatgacataatatccatgtgtatcaagcctttttattcctgcatctgttaccgttattctccctatgcctctcacagccagaaggaaaactgaaagtctactatcttccttttggtaaaaatttgaaaagaagggcattcaggtagagatggcatttattaatgccagtgactgcggcagactgttcttgggccgctgggaagcctgtggtgataaacagcattggaggaagaaagagtcaccatttacatatggcacatgactctcatcacagcttgtgttgcttattcaccagtttgactttgcccttgccaaaaggttagacaacctctgctatgccctcctcatcctactggcaaattaccactttgttcccattttatgaaattattgaataaagatcaccattaatatttgtcttttttaataccagttattgacaagtgatcgtcgttcattcaaaaaatatttattgaatgacagttaaagagcctttactgtattttaatttccaataaacatatatgtgtcacatatttttaaaaatatggagaagttcagcgtttttgttttgctttactttggtaggttaatgcctgatgttcataatcttttccagttcaacaggctgggtgagtggtatggtaccataaaaaggatgatcagctggaaatcaagaccttcaatctctacttccattccctctaacaaacagccatggcatgttgtcatttaattctgagagagcttcatttccacatcttcagaaagacagaacaatgctagatgtacttgcatgtattccaatagtgattgcctttcagaccttcctcttctcccatttgaatagacattagcctcatgagtgacctccacacctgtactctccccatacacgattctgcatatagccaccaaatgtaactttctaatatgcaaaacataaaaaaaaacttcctggtttttttgaacacattcatctcaattgagcaaggaatcatccatccacattgtatccccagtccacctttcccgcatccttttcaattttttgccaattgcccatatcccaaaacctccattacggtcatgtcaaactacttactggttcctgaactcaattggtttgtgacttcatactcctcagcatttttttttttttttaatcagccaataggctgaaagctccaacagggccaaaaaaaaaaaagcctttttcagcttagtcttcttagcaactaactgattgtctgcctataaaagatgtttaatcaatgtttggaagagatggacttgaatggcctgttgtactcttgttggcatgaaaatccctttaagtttctagtctatagttgatatcaatttcaaccccaatacaaccctagccaagcaaaattcgtctcttcttccttctgctcccatgcatacccccgtggtaggacatactatatagtcttgtaattgcttttgattgcttttgaaatacctatttttcccatttatatgccatctcttaactacagtgccaggtatatggcagaatctcaaaactgagttaaaaagactaagatttctgggctaggcgcagtggctcacgcctgtaatcccagcactttagacggccgaggtgggaagaccacctgaggtcgggagttcgagaccagcctgaccaacatggagaaacctcatctctactacaaatacaaaattagccaggtgtggtgacgcatgcctgtaatcccagctactcaggaggctgaggcaggagaatcgcttgaacccagaaggcggaggttgcggtgagccgatattgcgccatcgcactccagcctgggcaacgacagcaaaactccatctcaaaaaaaagaaaaagaaaaaaactaagatttctttcaaacctgtaatctgatgatgattgtatgcaattctttttaaaaagctaaaaatcttagattgagttatttatgaatacaaacaggtatgaagcagaaaccacgaaggcagctggcaaaaaataccagagtaagtacagctaggaactgtagatgccagtgtcagtctacatctttgaactgtatgaaagagcctattggacactaagtatttatcaaattctttctctttgaagctagttctaaaaacaatagaaacaaaaggaattttagctaacttgctttaccttggctacagaatattttaaatctaacattccaaatagttcttaaagtattctgaactggtttctttctgtgaagacaattatgatttctgagtctatgaataattgtatacttacgcaatgttaggacagtattatctgtaaaatgatttgatgttcaatatttctactattaatcttggaaaagtaaaaaatatcttctatcagaggaaatctaacactctcaaaaataagttaaatatgatacaatggcagttctacaacatccagatattcaatagtaggcagcaattattacttgccataattcacatctttgaaaaattcaagagggcaaactaattttgccaatgtgaaggagctgtaagaaaaattatgctttaatggaaatataagatgtttttgttgccttaagtattgctttttaatccttgaaattcagtcaaatacttaataattattttccatatatcttattagacatattagcactcatgctggttagagattttatcttcctcagagccataccaacacacccttctaaaccctactttgcaacgctgaggcaaagactctgcaaaccgtacttctggctttactgactgactctcagaatctaaaggtagggagcaatagagggagactgcaagcctggaggagggacaaaggatttactcattcacactagcttcccatgcacttactgtccttattagcagttccctagacgtgcttcttcatgcctgcagcagcactttttagtaacaagctattcaatttagcttgtgttttgtttttcaaaagcttagagaatcagcttcatcgcccctgctgcagaaataccagcaccacctggctggcagaggtccgggcctcagtcccattgggcccttcctgctatcccagagagggtagcaccagccacgtagcagccccctactcagacctgagctcagctttgtagagtccttcctcaagggttctaagtgttagtaattctaaccttttgtcttcccagccctaggagcggtagctactttgtgcacttgctacctcttctctttgtcaatttttcaatacctagatcccaattcctcttgttacattattttctgctacagtcactcaagtggtttctgtctgttaactgaccctggctgacacatcatcccaaacccaaaacttgtcactatcaaaatggaaatacattaagtgttgggtctgtgtttaatgggtaaggatgatttctcattcttccaaagaccacatattatattccactattgttttctactacttttataaaataatgactaaatatagatatacttcagtacaaggatatttgatcttctggacagccgtatccatatgtgcattctttctgtagatggaactcagttgtattagagtcaaaaacttttttaaaaattctaaccatggacagttgaatcaaatctagccctgtagttatttttcaaagtcaacatgaatagtaaaaaataaaatattgtcaaaaatccacctggaaaattgctataccatccatactatacacataatatggattagattttaaatactgcgtagtcacctcctgcacaccaaagtttaggaagacattgagctaaactcaaagagcaaaaagccagagtgtatgcagctttcttaacatgcaattcttcctgcctctaaggtaagccctagattgttttctttacctgcagggctttctgcagtatgtcttaatagtaaagataatccagcacagcatttgtaatatgcttgtgatcaagaatggatggaaacaggatggtatagtcctaacttaagcatgtaaattaattgcatctcataatgtcagccaatccacactcttagtcatacagattaaagaaccaaaaggaacccaaggaaatcagaaagggtaattctgcttagaaagttgctcttacatttcatatacatggttgaagtttgacctcaaaaaaagaaaaatcaatttcaggcactgaacggcaattgtgtaacttatttattaaatttataatacaatgaaatctgagttttctattactctcatttcttatttggacactggtaattgcttctttcttatgcatttttaaagtataaatcctgatactagctggcactaccccaatattttttccctttaactttggaattttccttttaaaaaattgtcattctagagttaacatgctaccagcttttcacaaattaaatttgttgttagaaaatggcttccatggccaggcgcggtggctcacgcctgtaatccccgcactttgggaggccgagccaggtggatcacgaggtcaggagttcgagaccaccctggctaacacggtgaaaccccgtctctactaaaaatacaaaaaattagccgggcatggtggcgggcacctgtagtcccagctacttgggaggctgaggcaggagaatggcgtgaacccgggaggcagaggttgcagtgagccgagatcatgccactgcactccagcctgggtgacagagcaagactctgtttcaaaaaaaaaaaaaaaaaaaaaaaaaaaagaaaatgacttccattttatccaaaatttaggctcttaaaaatgtatcccttttcatgatattcttaatattaatgttctgtagatgttctatagaggcacttgaaataaactcaacatatctaataaagacagaaatggaaaggtaagtacataggttttctggttttgatgtactctatcccttgcctgttttttcttgaccaatacatacaatgttacttaaacatgccatcctcaatattcccaatgtcccctatactaagactagtcttgaccccagactgaaggaacttaaagttcccactaggaaatagtagggtgacataggaaagtaactcatccgaaaagattttctttagtggttcaacctatacaaacataccacccagggaatacagcaggcccagtgataattctagacatattcaacataatgatttccaatcaggtaggcaggaaatgaggaaaagctgttgagtgacagttaagtggcagggaaatatataattaaccaatcaatttaacaacaattagttaaaagcggtaccaacagctacttttattgagcccttactatgggccaggcactttatatacatcatctaacttaatattcaccaaaaaattcaggaaggcaatatttgtcaatattttgaattttattttttaaaccaatggagagtctgacagaaaatttgaacaagttgcaccaagtcctaaaactaacagatgttgctggaattggaaccaggaccatgtgctacagtaacttgctcaagtttctactaagctatgctccactctacgcaactctaagtttcatcaatacactggaactcatttcatatactcattccccttagtctattaccatgaaatacactaggttcaaacttgcaataagaaatcattaagggactcatcaccttacaattccaagtacagacaagtgtggaaatgatcctaccaaacaaggagaagtgtatcactgtcgcctttacatcttctcaggatgttaactttatctccagcttaatgacaagcacaaattcttgtagttcttaaatttcaggctgttctttagttttatagtacatatttaactgtatttatacccatgcctgagaaaatgctgtgtcttataaagtcatataatgctgaaggtcaaggaatatgctcttgccagatttgtagggatcctagcctagcaccactcacacgtaatcatttattaaaaattatttttctgatcatgatgctaatctgttcagagtcataggcccataaagacaatatttcctatgggttaagatgtgctaatctcattaactgaacaaaccagaatgaatttaatcacagcagtcaagggaagctaccgcatcattccaagacaaattagagatattgtacccctgtggtgttatctttgatttcgattagaggtttcaggctgcttcctatggctagattcaaaatattaagcctactaaagagaatgaaaggtaagtttatgactttgcatcttggaactgcactactgataactgcaaagcctaaggctttgaagagaaatgacaaaaaaaagtcaatcatattttcataaatattaagcttcccaattgtatataaatataaagaaaacatgcacattactttttaaaatgattcaggagataaactactggtataagtgatcatgttatcactaaatctcatgaaaaatatattaagctataacgattagcctgcttttaaaaatgtgtatgaaagtcagttattaaaagctagatgatgttgttaaataaagaaacttacaatgtgttgaaatttccctattggagaattataaaacaaataaaatagtgtttttctgatgcatcacataaaatgtagaagcgaaatttgagggtttagaatatttcaataaaatattaaatgcctgggcagtctccgtaattgtttcccttgagggggaaaaaaaaaaaaaaaaaaaaaacctttcctttcaggtagtaggcacacagttttactcaccccttgtctctccaaatctagactccaaatatatattagtcacaataaaactcacattcttattctgcttgactaatttgtagtcaagctgaatacaattcagtggaaactgaatatgaaataaattcatctaataaaaaggtaccaatgactgtataacaacatatgtagataaaagtgtatcatatataaaacattcaatcccacatggcagctttcctggaatataaaatcattttatcattatgggtattagctcatgaagtcagtattattttaaaaacatgctaagaatgttagcttcaaaatttaatatctcaaaagcaggattttggttataccaagtggtttataaaatagagatatttatccatacacagttttatgtgacaatttaggtgtccttatagcttcttggtgggcagtgtaaactggtaaaaaataataataataataattttgctaagtatttttgcgatacatataaagaccctttaaaaaatgttaatatcctggctgggcacggtggctcaagcctgtaatcccagcactttgggaggccgaggtgggaagattacaaggtcaggagatcgagaccatcctggcgaacacggtgaaaccccgtctctactaaaaatacaaaaagttagccaggcgtggtggcaggcgcctgtggtcccagctactcgggaggctgaggcaggagaatggcgtgaacccaggaggcgaagcttgcagtgagccgagatcgcgccactgcactccagcctgggcgacagagcaagactccgtctcaaaaaaaaaggtaatatcctttgacctaataatttcatgcgctggaagctgtctaaaaggaaacaaaatggtctactgggttatttagaacaacaaaaataaaaaactaaatgcctaactttagaataagtggtcattatgtgaacatttaaagtgtgtctataataacctaaaatcacttatgtgatagtaaaaaagggtgaaaagtcataaatatagcacgatcacatctaaataaatagcagaaaaccctcatttcgggtaaaaaggaacccaatgaaatatgccaaaatgataacaatgactttaagtgagaatatggttaattttgtttccttttacttcttccattcaattgggaatattaataattggacccttacagctgggcatggtggctcacacctgtaatcccagcactttgggaggctgaggcgggcagatcacgaggtcaggagatcgagaccatcctggctaacacggtgaaaccccgtctctactaaaaatacaaaaaattagccgggcgtgctgacaggagcctgtagtcccagctacttgggaggctgaggcaggagaatggtgtgaacccgggaggcggagcttgcagtgagccgagatcccatcactgcactccagcctggatgacagagcaagaatccatctcaaaaaaaataaataaataaaaagaaaattggacccttatctgttatatacaagaatcgactcaaaatggattaaagacttacaggtaaaacctgaaactaaaactactagaagaaaacatggactatgagaggtggctcatgcctgtaatcccagtactttgggaggttgaggcgggcagatcatgaggtcaggggtttgagaccagcctggcaaacatggcgaaaccccgtctctactaaaaatacaaaaattagccggtcgttgtggtgagcgcctgtagtcccagctactcaggaggctgaggcaggagaatcactggagcccggaaggtggaggttgctgtgagcctagaccgcaccattgcattccagcctgggtgacaaagcaagactgtctcaaaaaaaaaaaaaaaaaaaaaaaaaaaaaaacatcaactaaaagcttatgacattggtctgggcaaggattttttggatatgaacccaagagcataggcaacaaaaataaaaatagacaaatgaagttgcatcaacctaaacagcttctgcacagccaaggaaataatcccttttcaggtatatggtatacaaatattttctcctgctccatgagttgtcccttcactctgattaatatccaaaaatatataagaaaccttaaactcaatagcaatacaacaacccaattaaatatgggcaaaggacctcaacagactttttttttgaaataaaaaagcttttaaaatatgacaaagtaaaatcacagtggcaactgtgattaaggaactgaatttttattttttattttttttaagttctgggatacatgtgcagaacgtgcaggcttcttacataggtatacatgtgccatggtggtttgctgcatctatcaacccgtcatctaggttttaagtcctgtgtgcattaggtatttgtcctaatgctctccctccccttgctccctacgcccccacccccacaggctccggtctgtcatgttcccctccccgtgtccatgtctcaacgagcatgtcttaagggaaacaaatggacaacaggtatatgacaaaatgcttatcattagtcaggtaactgcaaattaaaacaatatgctatcaccccacacctgtcagaatggctattctcaaaaagacaaaggataactagtgttggtgagaatatggaaaagagggaaaccttggacccttaatgggaacataaataggtacagccattatggaaaacagcaggaagttcttcaaaaaaaaataaaaatagaactaccatacaatccagcaatctcactactgggtacatacctaaggaaatgacatcagtatatcaagtagatatctgcacacccgtgtttattgtggcagtattcacattagacaagatatggaatcaacctaagtaaccatcaacagatgaacggattcaaaaatgtggaatatacacacaatggaacactattcaactttaataagaaaatcctgtaattgggaacaatgtggttgaacctggaggattttggagttttcaaattctcaagtccaggcacggaaaattataatttttttttttggaaaaaaatgtgaaatatagacactattttctccgtctctgagcctagatactattttcctggactggatggagaatgtaaagtagaaacaagagtgtgttcctgagaggaggggatggtgaaagaaccgccaccacaacagagaaggttgggggtatccaggtgcagaagtaattgggtcccattccagagtccagcccaggaatgcaacaagactccaaagttatgtcagacccaggcaagaatcgtgagcatgtgtcttagcaaatggacatgagctagccacccagtacccaggcacttcagcaggatatagggtacagtagaataatttcccacatgcctccagcaaacacagtgctcaatgggtttttggaggatgaagaatgacaagggaaccaccatgtttcttgaccgtacagagatatgaaagggcctacaacttgaggccaaggaacaaggtccctatgggatgaattgtacatgaaatcaggtaagccacacccgccttcaaatcctggcactgtatcagtgtcaggactctgagctaagccatcatatcccctgtgacctgcccttatacatccagatggcctgaagcaactgaagatccacaaaagagtgaaaatagccttaactgatgacattccaccattgtgatttgtttctgccccaccctaactgatcaatgtactttgtaatctcccccacccttaagaaggttctttgtcattctccccacccttgagaatgtactttgtgagatccaccccctgctcgcaaaacatcgctcctaactccaccgcctatcccaaaacctgtaagaactaatgataatcccaccacccttggctgactcctttttcagactcagcccacctgcacccaggtgaaataaacagccttgttgctcacacaaagcctgtttggtggtctcttcactcggaggggcgtgacaatcaggtcccctccagaaatttaagacaaaaccccagagaaagggggggcatctcagtcctaaattggctgagatgaaatatgcaggatctaccggaaagtaggctttatatataaattaagttcagattcaagaaaaggcagttattgagattcactgccactgcatgtagatccttatgtggggatttctaagaatcattgtccagcacctaaactgcaaagcaaaccggtaataaatcagacaacaattaagagccaagtcatcttgagacaagagctcaggactcagagaagcagcctgcaaatgtgaaatggacattcagaagtcagtgagtttctgaactagcagtgcccggttacgaagctgttgaagagccttgtggactgctttatatgttctgggtagttccataggtcctcgcagaaagagaaaataaacctttcgttgaaattaaccttagacctagattcttaaaggactcaaacttttcgcggggaaggaaaggccagtctattgacaggagctgtagatattaaggcctgtggggggtgggggagggggactcattatctgggaaaagccacacccttaatccatcataaacagtgatgcctggggcacagttgagactacaccttggaggaagaatctaggtttttcctatccaactccaaaagaaacacatttcaatggcaactgctgaaaaacaagcaaacaaaaagtaccagcacctttttgtttctttggtaagaaggcgaaacatcccagattgtctaaaaaaaagaaattcgggaaatcagaacgttttatcatgatctggggttatgttgtccagtaagatagccactagttatatgtggctactgaacatttgaaatgggactagcataactgaggaagccaaattttcattttgctttatttttgcttcaattttatttatattgaaaacaaacagtttttaatattcttccattaaccataacttcattggtttgggagaacaagtttactttaacccatgaaaatatggcaactgaattcagatgtgctgtaaatgtaaaatatcctccaaccttaatgatttagtacattcttttcactaacgtaaaatgtctcattaagtcttttttgattacatgttgaaatattttagctaaataaaacattaatgtcacctgtttattttcactttttaaagtggctactcaaaaagtttaaattacatatatagcttatatttcttttggacagcactggcctggagtacagttcaaaaatagggcaaaaattcagagttacttcttccacatctgagttttgcgaacatttattcctgctacatacacaccagtctgtgtatctacacataatgaaaaacagacttttctcaatcccctcatatacagagggcaggtgagtgagccagtgagagaagactgagaggtaagtggatcatataaattaagatggcctaacaacattagaatcattaggatttaatcctataacttatgacaacagtccaagatgcaaagtgatttttaaaagtgatctaaattaaattttctagttttccttttctttccctttaataggtttcatgaaaatcaagaattataaggcggggaggtaaggctggagaagacaatctaataaagcgatgtaggacaaatgagaaaaatcaggcttccttattctactccaacactttccaactgtcatgaccttcatggtctgtctgtacctcaattctctgatcagtaaaatttggatgaaatatgctggactctgttgagacaaaatgaaaacataaggagagtctatcatctgtaaatcactacattatgtacccattagtattttattgttagcaaagattaatagaaaactgacaactccaaggctggatggcatgaagccctacacctagtagttgctgccatagtctgatttgaggttcctcaaatcattcttccccagcctaatcattttttctcttcagacctggaatcctgccatcctctcgcgtcatagtttgggggttactgcctgcatatgccaatgaacagtatagccacgtgacacagaaatgaaggccacagaaccataattcatcagttattcaatgtgttagctgacaacttggaaatcatagagcactcaactccaagttacttcctgaaaagcagagaaatgcttcctcagtgaggccacagaactcacagctttacattttacctacaatttgcacatgatccacatgatctggcctcggctttccctcaaccccttacaactgttacagtttcatagccttctgtcagtcactagacaaaactcagacacttccttccagtactggcaacattactgcacattcttcttttaggttttcagccctggctacacattagcatcacccgaggagcttttaaatctgtaccattgtgtgtttctgatgccccccacgccatgttgttttgtttgttttcgttttttgttttttgtttctttgagacagagttctactctttttgcccaggctggagcgcaacggtgcgatctcggctcactgcaacctctgcctcctgggttcaagcgattgtcatgcctcggcctcccaaatagctgggattacaggcacctgccaccacacccggctaatttttttttgtatttgtagtagagacggggtttcaccatgttggccaggatggtcttgatctcttagacctcgtgatccacccgcctcagcctcccgaagtgctgggattacaggcgtgagccacccggcctctaatgccccctttctttcataacattacacaccaagtattatttggcaaacttctcatcccctatactgtattacttattgacattgtttcccagctcaggcctacacgcttggcacattctgtctctctggccacaatgatcgtgtaagcaaggctgaaaaccaacttaaaggaatgggaagagttacaaacttaagtctcccacacatgatgcaggatgatgactttatcagatattttcatgattttatgatatttatcagacattttctcctgggaagtttatgttagagtaaaaatcatgtatcattagggagtagaggtaatgctaaaagcaaggactgagagtagttaattcatgagaatgaatgatggaatcccatgacgtgatagatcagctgctacactatggtctcaatagttcaattattcataaaattacactgatcgtagttttctaatgtgacatttttgttttgattattcggttggtcagacaactgagtaaccaaatggtttcgcctacttatttggttattcagttgttcagtttcttgacctttttaccccatgcttccttaacataagctgaatttatctctgttcaatgtaacacaaaagcccgtatttagagccagattataccagtttccagctgtgtcctcttaaacatattactcattctctcatgtcttccatttctttccttaaaaaatgagaataccacctatctcctatatatgtttgcaaacatgtttacaagatatatgtgaattaccttgcacagttagcatctctcaggatgtgaaagtgaccgtcttcctcctcagtaatttactctttgtcttatcaaagccattaaaacccctcagaggtgattaaatttgctgtgataaacagtggggttattaagcaaagtagtaaactatgaacacacctaagttttttcttaaatattgtagtggagctggaaatttttttttttaggtatttcttccatatccacaaaaaagcagcaagcccactgaaactcatctgtttgtgctactaaataatcccctacttttcctactgtaggttgatttattggtccccactttctcattcctacttaataggatggcatatctagcctatggtgggaaatgtgatagcctttggtcaacggggtgttaagaaaacatgacaggagcagagccttgagatgggctggcatgtttgggcttgctatctagtgacaacctatgaaaacatgcactgggtggccggtgccattccagtgtgtgcctctggacgtgacacatcaaagaaatccaaaccaaacctgccgctgaaagccaagcctagcaactaccagcctgatgcagaaccaaatctagatcaacttaggtcagccaaaccccgcatgaccatgagaattaatgctatttaaaaccattaagttggaggtaatgattattacttgatattattgttttgagagctgaccaatacatctgcccaaataaacgcgtttgttcacatcatgatgttgtactgaacccctataaccctcaatagcgaaggcatcaggttcaagagactgaggaagaaacccatagccagcaaacgaggcattgggttttattagaggtttacatacaggggagggaattcagtagtggtgggctggacaggagaagtgccttacctgtagaaacgatccagtggtggcagactggacaagatagcctcgcagcacagtggtagtgatggcggcggtgggatgagcgggcaaaccaacgctgcttgcgggcagcatgcagtttatatagcatttttacttaaccctctgcccttaatgacgttcacctggcaaccttcatccaacccaaaactcggggcctcaatccgctgtatgtatggcccgtgttccacgggatgcacttggggctcagatgttcctcatagacaaggaagggctctcttgctgggctactcccagattccgtagctcggaaaacacattcaggtgtgtctgcagtacagggtcattctaagggtatgcgcacattattgcaatcaggtgcatttaccatatacttgattacctatcttactggttatgttgttgttttgtgtgtacgtgtgtgtatgcatgggtgtttttacagagtcagatgtcaaccgcagggacaatacaagtgtcttactcatttcagcctgctgtaacaagataccatagactgggcagcttaaacaacagaaatttattttctcacagttctggaggctttaagtccgaggtcagtgttccagcgtgttcaagttctggagagggctctcctcctgatatgtaaacaacaaccttctcctgtgtcctcacatggcaaagcaagagcaagctctctggtgttttctttacacgggccaccggatcagagccccacctgcatgtgcttatcttaccctaattaattcccaaaggttccatctccaaatatcgtcccattgggggttagggcttcagcatatgaatttggggcaaacacgaatagtcagtccataacaacaagtgaaggactacagaatctattttatacagtaatattttcttttatgagctatatgaaagtgacaaagcaagtggtttagtattgtaataccatgacaaagattaagaactgaactgagcaaatactttatacttctggttcagttcatcataactgaattacccaaaaatataaaaggagagctgtagttgttctagaaaaatcttccttcgtgtaggagtgggtttgcgggttactgtgctaatccacacctggagttttgggcgtcaaggttgataagggtcaagggtttgggttttggctctggcttgtggaagatcgttttctgagagcattcttgggcaccagctggtcagacactcccattccaatgggacatagttttcaacagagaggaataatccaggtgtatataaggcaatacaagaaaccttgaggcttccaggccttagcaagaagaattggagtggaagtttaaaagcagaactggaacattttctaattgagggtggtagagagaattctgatatttatatattcggctgaggttgagagctttcaaggatgctgagctggctgctggcttggaatgaacgtgtgtgtgtgtgtgtgtgtgtgtgtgtgtgtagtgtagtgtaaataagcaacattgctagtcttgtaatcttataattgttcataagagaaaatacagtctagaggaagagatcatctagtttactgggaactagtaatgcttatcttgccgaggtttaaatgaatgatcacggctgtaatgacttataagaaaaattaaatctaagagcacagcctctgagcagaaactgtatacagaggtttatgtacacagctgtgcgatgaaaagaattagatgtgctgtgccctgatgcttttgcaataaagggttcaaaaatctgtggagaacaccctactccttagtacaacccagagcagtctgctgtagcctgcttaattggtatgctatgatcaaatccctcttgattacacccctagggtataataggaggcaggttttactttaacgcctttcatcatacagaaagtaaactgctttatggataaaaatagccatgtacagactcactattgacaccagccacccctggtgacttcaaggctcatcagcaatgcacaactgttttaaaataaagcaaagagtcacatgtagaattggaattacaggaataatgagaagtaaacagaaagaggccacgttgccttgagggctaacctatagattagaaaaaaatcggggccctaaaagacacactactgatggggtctagggatagagctatttttaaagcagtggtaacaaaacaattggtgtcacgtaacactccagtaactaagataattcacttgactgcaagacaagcaaaatataggatgttaaatgtgcaactatgtctcaaggttacccaagttaaaatttggagcaactaaacatgtctcattttacaatgacaaaatgaacacttagttttcactgtgtttaagaaaagtgtctttgccacattaaatgcattatcaggagatacattattatcacagctgcaaggaaaatatttttcagattcaaagattcaacaacactgtggtacgcagaacttgaattgctgtcagatgaaaagttaaacgtcagcaattgaaacaacaaatattcaggacaaagtgtttatagccctttcttttgagggttttcacattgaggaagtatgctttttatcttctccagtgatactttaacatgggccttcaagcacctgaataacagcaattacaaaaatatatttttttcatcaacgactgggcattttatgcgttttttttattttgcctattaaatatgcccttaaaatcgtgcttgttcctcagtctacttattagaagttcaaaacaaggctttggttcaaatccagtttctgagataaatttcttaattcattgtaaaaaatattaatggtgaccaaaattttaatgtttttagaaaacatcacaggtaatcagaacaaacaggaataaaaagaacaaagagtaaaggaaggagaaggaaggaagaaggaaaggggaaatataaggaggagtagagaatgaagaggtgaagggaaaagctgtgatttttattttcagataaagcacaggtagagaaaatctatgacattaggagagtctttcatttaaaaacctcatagttttaggtaggagggttcttattggtggaatctttcatacttgttcaatccaaattatccattaattgttctgtctgatttattagctttcatcaaataaatatcattttctatgctttagcaacttgaaatcatttgccaactgttgttatataatacaagtcgaaaaagttggtatgcccaaaggcttatctggattttgtattcattttttccattttgaagttcaaaacaagtcatttctttttctttattctctgcaatcaatacaaaatgtgtgttcatactattaagaagagcatgactgttaagaagccttagttcaatggattagtagacaaccatttttttaattagtcttccccctctgaacttttctccactttccgcagcaaatggaaacgtaatgagaatctcatagtattctgccaaaataaaggggatgtcaggcaataaagcatatccttgctaaatagcatcacaaatcccatatgtagaattatcattttatttttaagagttttttccaccaaaagccaagaataaaattgctttgaaggataattgttaaatggttatgctttggctctatatttgagcctccacgtaagtctttaattaataatttgtgctatggaccgtgttctgatgagatgttttgctaaggagatatgctcccttcccttactgccacccacaagagtaaataaaagcaagacactggcgttttggaagtcaaactgggattctgaagaagttcctgggctctgagtatcatgctacacagtagagagtcacttcctgcctctctaatatctaaaacaaaagatttgaactggtagccattgatctaattcaggcctgagatacatttggctagtttgatacaggacaggttaagccccaaaatcagggcttggcctgggaggattcttggctttgcctaggaaagaattcaagggcgagccagtggcgttaaacagctatgttttagtgaacattactgcgctttgtgaaatagggacaactcataggcagtgcctccaaagttggcagggtatgggctgctggctactgtatttatatccatttatacccactttcaattacatgtaaattaagtggcagattaatgcaaattgagagacaggttatttagaactttctaggaaaggggtggtaacttctgggttattgccatgtcctttgtaaactgtcatggtgctggtgggagtggcttctgctaatatgcaatgagggctgctggggatcacttttgttgccatctgctggtttctgctgtttttctcacttccgttggtcgctgcctgctggtacctgccagtttcttcactttatcctctgggaatgggaaataagtcctgcccaactcctacctcaggcttgcacagaatttttaattggaaaacctttttccagttacccaccaaatatacatcactgcctactatatatcaggcactgttccaagtgcttgggattcaccagtagacaacatgcacacataaaaaaaagtgctcaacttatgaggcaaatatatagtgcactgggatgttttacatacaactccagattcttaagttcctcttgaaaaataaaatatatggccaaaaatagctctacattctgacatggacactgctagactgaattgattagcagttgcccattttagactgggcacaggcgtgccatttgccagtattctttccaatttacacaatgtccgtatgcatttagatctttgcttcacctatttccattccctttcaggtccttgcaggtattttaattgtggactccattcactgtattattttattttatttcagttcagtttgtatcattttgagttcctgtttttaatttagtataatatcatagaaagtgtttgtacttaattctacggccgggtgcggtggctcacgcctgcaatcacagcactttgggaggctgaggcgggcggatcacgagatcaagagatcgagaccatcctgaccaacatggtgaaaccccgtcgctactaaaaatacaaaaattagctggtcgtggtggcacgtgcctgtagtcccagctactcaggaggctgaggcagaagaatcacttgaacctgggaggcagaggttgcagtgagccgagatcgcgtcactgcactccagcctggacaacagagcaagactccgtctcaaaaaaaaaaaaaaaagaaagaaaaagaaaaagaaagaaagaaaaagtgtttgtacttaattctaatgcagaatgttatggattcttatattggttctggtataaataagctaaataaatttaaacatgttttttaaactctgtgtggtccaaatatattctcagtaaagtaagagtttgacttatttgtgggtttgaaattgagttcagttgaaactcacaattcagttgagctgctgtaatttcagttttatggttccgtcttccttatgctatatatttttaaaagaggttttgttgataaaaaaaagaaagtttgtgaaccactgggctttctgatctctatgatctcctacaaatttaaacttatgtgatttaacactaatcaaaagcaaatcggtattcctatttaactttttatatacaaaggtcttatttccttaaaattccctaagttggaataatatcttaaaagctgttcttccatagtgtcaattaagtgcataataaactaaaaatatttgctgaaaatacatacacatctggtaaaattgtgttggtatgaataggaataataaatacaaaaatgaaaattgggaagagagaatagtggtgcatttgggaagggtggcatgtggaggagggcttctagagtattagtcatattctagtcaatttttctttaagagaagggccctcactctgtttcccaggctgaagtttagtggcactatcatagctctcagtctaaccttgaatttctgggctcaagccattcaactgcctcagcctcctgagtagctaggactataggtgcatgccactatgcccagataattttttaattttttcatagacttaatgtcttgatatgttggttaggctggactcaaactcctggacacaagcaatcctaccacctcagcctcccaaaactctgggattacaagcacaagccaccacacccagccccctatttcttaagtgaagtgattatgaggaatagctcaattcattattgctctatattccttacacatgtaaatcttatatgtacatctatagcaaatgaaaaaaaaggaattttcgttgatatttcctttaaatgaagatcacattggaggtcaaaatgtcacaccaaaaggaaagtaaaaaactcaaagtaaagatattttgttaaaattatgaagtgttaaaattgcaaatgacatctcatttgtaaatattgtattattatttattaagaattactcgaataagccaaaatgatgaaaatgcttgttatatagagaaatctaaaatgtaaggcagtaagcagctactcttccaataactccaaaagatgaaaatatgtttggtatactaaaaaaaatctaatctgtaatgtagtcagtggtatattttgaaagaaaagtaaaactatagttttgattatttataaaagaatgaattattttatatttaaaataattaagtcagagttaaatagtagtaacatgtaatttttaaaattgataggaagtgtatattatacaaatgtgataaacagcatttatactgtggaaaatttgtatcaatgacagaaggtaatctcccttcttactacaattcttttttaaagggaaaagaatataaaagatgaacaagtgtacagtctgaaaaggttaattttcttctttaaaaatttcaacactttgaaagtacctgcattcaacttctcttcaaaattattacttcttaaactacagtcagccaagcaatttgctattgagaactctcaaaatccattattaaatacaattttcaaacatacccagttttttgaaacacaaattttaactttgcttttgaaactgactgatgagaaattacctaactttgaaaaaatattcattaaaaagtccatattccacctagtcatgtgctaaatatcagcattataagcagctgtttcaaaacctagttttatgcaacatgtgccctttttaaaatttttcataaaatgtaatatctgttggtagcactactaataatattataggaaaacgctgaattacgatcatatagaaaattataaaatagaaaaataaacagagtttagtatagagtgtctgaacatgtgtaaagcaaggggtcagttgcggaggacgacttattgagatatttgtaatatcctttcatctacttttatctgttttatagtttcctagtaaattataagcagtgattacacccttaatctttggctttatggaaaagtataaaatcgctcttcagttttattatgactgtatatggatattctatttacaaaaacatatgctattacattttggccaatctttgtattaatttttgtaagaatatattgtgtaagtatttatagggtaataatacatatcatacgaatgttaagagtgcaatagcaaaataaagaaccatagccaaaataaattcctcataagcaagcatcacacacacacaaacacacacacacacacacacacacacacacacacacacgcagaaacatggacattttcttcactgactcagaaaaaattttcaggtaaaatgtcctgtaaatgttcgagtggtcacaagtaaaaatttacaaagtgtttctatagttccagcagaaagcgaggtgcattagaagaaaaatattcatgatatatttagaaagacaccaaattttgataaaacaagtggtaactcagtttaattaaccaaatatataccacatgcaaaatatgtcatagatactgataattcaaaataagtattctctaatttggaaattagcaacacacatttttgtgtatatatgtggacagatatattaatccatccctggcataggagtatcccaatgtactaatttgaactcttataaagcattcagttcaatataactcattaaatggccctacagcccaaagaagaagccatctttagtatgcatgatacaagctttcatttctataaaaagaaatggcaaaagattagatttgcaaagcaagataaaaagacacttgtcagctcctagatcttccaggaagcagcatatataggagaaagagaaaaaaggtaaaacatgattgatataggaaaacagctttacattataaattgtatggtgtctatatacgtgggaaattttctaaattaaaaacaagtcaagaaactataaagaaatttggccaggtgcggtggttcacacctgtaatcccagcactttgggaggccaaggcgggtggatcacccgaggtcaggagtttgagaccagcctggccaacatgatgaaaccccatctctactaaaaatacaaaaattagctgggcttggtggctcatgcctgtagtcccagctactcaggaggctgaggcaagagaatcccttgaacccgggaggcggaggttgcagcccaggttgcagcccagcctgggcgacagagtgagactcagtctcaaaaaaaaaaaaaaaaaaaaagaaactaaaaagaaattttcatttattatcagcaactaaaaggattaagtacaaagataatgtaactaagcatttagaggggaagactggtatgtgtaagggtatggtataaaaatcataactcttcagaagaaacaaagacttttgaataattgcaatgaaatgtatgtaggtagggtggggaaaaagtgggagaagaagggaattacagcagaggaggcgaggtagaggaaggcaaaaaccaaattacaaagggcattttgtgcaatgctgaggggtttatttttataataaaagctgtagggaaacgttaaagcattggtttccaagcctagctgagcattacagttacccagggagctttcttaaaatgctcactcccagtccctcatacccagagattctgatttaatttatcttgggtggagcctggtgattttcacatgtagctaaggttgctaacggctgtgttaatggattttaagtaaactacacaatcagatttatattgtggaatgaacactaatcctggcagtatttagactgattttggaatagactaaactgcactggatttcttatgatattatcattataatataggaaagaagacctgaagatctaaagtgaagccaggtagtaaggatggataaggagtgggagtggcattcatagttttaatgcgactggaacacgagaagcaagatatcatagtgattataaatattgactcgaattcaaactctactcctgccactttgttgttgtgtgaacttagacaagttacttaaccactctaagtctctttttgctcatatgtgaaatggaaataataatagctgcaccacagaaattttcaactgtcaaaccaggtaaggaagttaataatggataacaatatcaaagatatagcaaatattcaacaatggacagtcattatgaaaatctagctgtctcagtaaatgtgctggatgaataagagggaaaggtgtagcttggcttctagaatttatatgtaatcttttttcttaaaatataaaatatatagagaaaatctgtaagtcataagtgactcaataagttttcacaaatgtaatgcacccatttaaccagtatcagatcaagaagccgaacattatctaaacttcatacccctttcaagtcatgtctcctagggtatttatttggcccactaaatgtttagaaatagcaagagaaagattataagaagaggtgtagtagagaggaagataggtttaattttggataagtggggtcaagagcctgtgggatattcaaatggaaaattcaagaaggttttgagcagaataaagggtaagtcatagacactgaactgacagacattagcatcaaagcagtagttgacattaaaaatggttcttttcatattttcttttctttttttggagatggagtctcgctctgtcacccaggctggagtgcaatggcggatctctgctcactgcaacctccgcctcccgggctcaagcaattctcctgcctcagcctcccaagtagctgggattacaggcatccaccaccacacgcccggctaatttttgtatttttggtagagacagggtttcaccatgttggccaggctggtcttgaactcctgacctcaggtaatccacctgccttggccttccaaagtgctgggattacaggcatgagccactgcactcagcccataatgttttaatggtgtatgattcaagtgactaggcataatatgttgcttgtctcgttgctcaaaaagtaagaaaaataaaagaaagagactccactcttttgctaggtttaacattgtgttgttgtatgtatatatgtatttctgtacacatccctatattgggaccatatgaccttccacaaagaaacaatcttacttaaaattgttttaaataaatatgtaaaaagtactataaaattttacattattttgcgacagaaatacaagttttgttactgattagagatgcagcaacagtttgcttttcaactacattaggaaccctatgagcattttttagataatttcatagtaataagtaggaagtacataagacataggattcactaacttggtgagaacttaattgctcacaagagaaaaatgctagactaatccccttagcaaagaatctatgattaaaagattctaaaaaataatttgaacaatttccagttaccataaaaagacatggttgagaaaaatgcaactttttgctattgatattcaataaatgtttactatatatataagttggggctgagtctttctttcattctttgggtcttagcataaacaccacctcccccaacaccacctgctctaaattaggtttcactggccactctcttgtccccttgtccatgagagcacccaacataatttgaaagtatacatttaattgtttgttagccagcttattgactatcttctccttaatggattagtttgtgaaagtttagaccatattcatttggttcactgtcatattcctggcacctagaagggttgttgacgtattgcagagattctcaatcttggtgctactgagattttgcacaagatgattctttattatggtgggttgacctgaacattattacatgtttagcaacatccctggtctctacccactagacaccagtagcaaacatctcttcttttagttatgccactaggaatctctccggacatggtgaaataacccctggacggcaaaaccacccagagttgagaatcactgaataatttaatacataaatgaacaaatgagtgagtgaatgaatgaatgagttaatgaataactgtctgattgctcagaaaacggaagtagaagcaggagcaaagcacattccagtcagatagtgatatggtttaaattcatgtccccacgaaatctcatgttgaattgtaatccctaatgttagaggtggggcctggtggcaggtgattggatcacggtgtttctcattaatggtgtagcaccatccccttgatgctgttctcgcgatagtgggctctcacgagatctggttgtttaaaagtgtgcagcacctccccacttgctgtctctcttgcccttgctcccaccgtctgagtcacctcgctccccgtctgccttctgccatgattagaagcttcctgaggccgccccagaagcagaagctgctatgcttcctgaacagcctgcagaaccgtgaaccaactaaacgtcttttctttataaattatccagtgtcaggtatttctttacagcaatgccagaatggactaatacagagggaacagtaaataagtagacaccgagggacttgaaagcttattacatgcaagaactaagacagagctagcttgcctggagctacaagagcaaagctgaattgaaatgggcgagggaggcatggtccagttatgtaggtcaaggttaaaaggtttggaatttactcttggtagaatgagaggcgttttaatgaagaggtgagatgatttaattgatctttctaaaaggttgctccaaatgctgaaattaggatttatagatggggtcaagactacatgagagagagcagttaggatgctatttcagtactccaggaaggagctgatggtacacagaagtgtcaaagttgagagggactgtactaatttgtaggccaagccaaatcaatcggccaagcaaaatggattctatataaatattatgatcatgaacaatatattagaatgacattatatgcataagacataggtttggttattttacatacatgtagatgaaattaaagaactaatttcctgaaagattttaaaaatcacttagtctctgtatttgttgaatgactatgatatcatccaaattccagaataaaaacattctatagtgtaaattcatgagaaaataccctattgagtattattggccttataatgcaagcttcacttaactttacaattgtggaataattttctcactgtgatgttcatttcattgcgtgaaacaggttcagtacattattcatgaaactacttcaaaatgctttgttttagatttaaaaaatattggtattcacataactgctttgccaatgtgaggtttcatacgaaattcattgtttgattttctgaaaacttatcatattgattttgtgtcaaatctttatgaacaagcatttttataataaagttttattcttttctcataatctccttcccttcatatctcactatagattgtactaaatattgtatctatccttcatgtacatacagttctacgaggaaataagaaattcaagcggttcattgaattaatcactaataggagagaattgatcaaaatttgctgtaattttcttccttcaaaatcatcagaattctggtaaagctttgtatttcataatttggactccacatattggtgacaattcagacactgagagtggaacacaaaggaattgggtaacgagatcactaagggaatttttagcctagtaaagacagtttctcaacattcaagaataattcaattacataaaaattcatataatagtaattaaatgacaaaatacttttgaatacttattaatgcacacccctcagagacctgaaatttgcaagactatatagcttaatttgaatttgaattttcttacttattttagcaaaataaacttaaggttcataagaacatagctcttcattcacttatcttggtcgtaaatactgttaaacacaaaatcaggtgcccacagctcacaaatctacacatgacacatctctttacgttcctcctgacctacctcagcccaaatccctctctacctcatagaatttgatattaactttctgctaactttttgaaaggagaatagttctgttgctacgagtcacccttgaccctttgcaagaccaaacatgccgataatttaaaatgtgatgtaggctctaatcaataattaagtgttgttctattaacttatgatatatcacatactttatttgattcagtgacattaatatcatcatcaaacggtattataatttctcatattttaatctcctgttctaccatgcagcagagcacagctgcatattatattttccatgggaaatatcagccatcatatggcttgtagtcttccaaatttctggcctacttttcaaaatcaaatgtctacaatttccaaaaaacactgaaaatatttttaaagtacattttgcaccaaacattttaacttatgagtaatcaacctttacaacatttgaacgtaaaacggaagtgctaaaagtctggcagcaaaaacaacctttcagcattttatgagagatcctgtatcgtcatattggtgaatttaaaatgattttaagttctttctttcttctcatgagactttagatctaagcagtctgtctttagcactaaccgggatcacttcaatgcaacattttcatggaacacagcatttgctgtcaatcaataagattataattacaaaataatgatgccttacagacccattctaaaaatactttgacatctgaatctatgaaagggctcaaataccaaaaaggatcttccagattcacatgaataaagttcctgaggtagttgatattttaaaaattccgtgtcatgccaattatgtgaacctatgctggttagatcacacctgaaaatttaggatgtattgtcatggtatgtgaactgactacaaaaggtatcaggaggttgatatttgctacataagagaaagatgtgttcaagaaatcctcacacctttgcatctcactaggcaaatgggttaattacatctgaaatcatatttcgatttggttgatagtctgataagttaatttaaggtgaccctggtaccatctaactgttttgtttttattccaaataggatattggccctttctaaaaaggattatgtagtcttgtctatatgagcaaaaaaaaaaaaaaaaaaaaaaagtaacctgagtataactatggtactaagaaagaaaatcagtatacacaggtaggatttatctgccataaagaatagttcactgctataagaatttcttacaagaaactctactggataatcaaccttctagtcaaactccagggaattcaatgtagtttaaactcaatacatattagggaaatcacaaaatgaatcatatgtagtcattctatggatgagttcacaatctagatagtatttccgtgggggtaatgaggagtatctcgccacgtcagaggagtgagtatccttctgccttcttaagtataacacatatagttaacataatattttcttgaagtaacagtagagagtcaagccttgtaggagaacagatattttctaccaagtctcagcttagtctgttactcagttttcttgccatagtactctgcaacatgctgaatccacggtttttgtagaaatgcgtccacaaaatttatgccatgaatgcaacaaaaaagcagtacacacatccagtaagaaattgaattcaatcagtagataagcttggccaaatatttgaaactcaaaaactaaatcattaattgtgcaaaagtaaagaaaaagtgggaaacgaaattaatgtaaaatattccaaaacattcttactatttttaactaagaaagcatattttactgatgtctgcaagccttttgttcttcactctttcaattctctaatcctgccatccaccccatatctttctttcatttggaattttggtttacaacactcagttgtagactcaggcatataacttgtgttttagtcttattcctttgcacaaagacaaaatacatagacaggacacattgatcagaaaaccagaaataatctatttctaaaatttctaatccctgacataaatgtatcaaaatcacacaataatttaatagaatgagaattgcacacacacacacgcggcacaataaaacccaaggtaaaccaaagcacaacaaatgtccttctgaacaaaaaggttttccagacagctgagagctactcctttggatgacagaacacctcaacttctggatgaaaggtttacatgaaaatgattatgtaggacagctctctttcccttcttatgtatggtatgtctaacataatattttcttgatgatttagggttagaattatgatgtgaagatatgactgtggaaggattgatcccaggtacatgtggatgttcacccctagaatgcaatttctttttcttttattttttttagatagagtctcacactgtcacccgggctggagtgcaatggtgtgatctgggctcactgcaacctccgcctcccaattctcctgccaagcgattctcctgcctcagcctcctgagtagctgggattccaggtgcccgccgccatgcctggctaatttttctgtgtgtgcatttttagtagagacggggtttcactatgttggccaggctggtctcgaaatcctgacctcgtgatccgcctgcctcggccccccaaagtgctgggattacaggagtgagccaccgcgccccgccctagaacacactttcttagaaagtttcaaaatatctttttactgttacagtattttaggaatctgaacacttattagtaaaaggaaatatgaacttgctttctctcaagtagtatctttctttctccacaaagccatgtcttagagctctttcaattatgggtattaaaccagtatgaccagaatctcagacaacagacactatcctgtccacacagagctaatgtttatccctgtctgcagtcttcatcaacagtttggaaaggaaaagtcaccctcgctatttcaatattttaagctgacacattttacgaattcctttacactctaaaagtggtctatatatttattagataggacttctcaaggcatgatatagcctagaattttctggaacctctgaatcctttattgacactgaaggtccatgatagtgcctgcaaaatgattgaacaatactaaatcttgtaaacaatttcacattatatttgtaatgtaccacagtcattgatcttatgaatgatggtgaaactggcggtgggaaagagaggtaaacacaaaaatgtgtatcctaacactaaaccagtttcaaaaggctgtgctcccaagttatcctagccataacatgttctgatttcttactttcacattaaactctgtatagtatattgtagaacttaattcatatctgctaaattaaatgagtgaatacataaaacggaaaactgaggtaaattgtgtactacttacactaaatcaaagtacagccttaaaggaatatacatttaataatgagttttattaaataaaaataatgtattctaaacaattgtctgcatttaaaacttgccaatggaaccatgaaaaaatgcccaaactcatttttcattaatgcaattcaaagtaaatccacagctagaaacaattttatactcaacagagtagccaaaagttaagtttgacattgtcaagtgttagaatttgggagcaagcagaatttttaagttcgtgagaatttaaattggtgtaaccaattttaaaaataatttggcataatcttggaaacttagaaatacatcatgtcagtcagaatctaagcagacacaaaaagtcatttgatatttaaatcagaaagcttaaattatagaattgaaacaaatgagagaagaacagagttgacaagctgtggaggacaaagtgactcagagtttagcaaccacaggaagccactattacccttaaagtacagggagaggaagggagaggagagaagaagagtgggagagaaggggagagagagagagagagagagagagagaaggaggaggatggggaggaggaagaggagaaggaatggggaggaggaggaaagaagaaggcagggtgcatgaattcagtgaatgaggttatgagatcattcattggaagctgcagctatagtgggcctatctggttggaggggggacatcaaagcatatgcagctgttgccaaagatactgcctgaaacacaaagagaggaagagaagcactcttgtgtcttccctgagtttccaatccttcaccatcagccaaagagagctggaagtcacctggaaatggaagcctggcacacacagtctacaaaggtcagtctcccagtggtacacagtagagcagtgtaaaggagccaaagagtataccagagggcacatacatgggccctgtgacccagcaatcccactcctacatgtatacaaggaaccttgtttgtaataggaaaagaattaaaactggaaacgaccctagtatccatcaacagtagtatgcataaataaattgtgggttatttctatgacggaatatgacataatgctgcagtcacagacatggatgaatcttagcaacataatgctgattgaaagaaacagtcacagaagaataaatgcaatatgattccaactatacgaagttcaaaagcatgcagagcaagactatttctcttttagtaatacatatatatgtagcaagactataaaacaaagcaaatttcacgaccaccgttatctctggtggtagtggggaagcgatggaattggagatgggtacatagatggcttcaagttactgtggaaaattcgaagtaataaacacatttggttatgattgaaactgtatgtcttaaaatcttttgttcttatgtaataagatatttttaaaagacagatacatgtttaactgattggcaagttagtataacaacatcaacctaaaagaaattaagtttatttttgtttttgtttttgttttttaaatctgaaaagcatttccctttcagcttgctgggtttcttgcactaaaagatgagggtttaataatcatagcagatcagaggcttcagtagggaggagatgggatagcttattgtgaaaaacgattttccccctagtttaaaagtggcccctggtaacatttttcttgaagcttctagttatatatatcgttgtcagtcactttgcaactttgaagaaacagttttcctgccgaagggctctattatagttaatatgtgtctacataatacaaaaagtcatttaaaaattattgctttaagaactatttattgagtgcctcctaagtacataacatcaaactgtgaatttaaagtggacttgcataatttaatcaaaatttatactaaggaaaacaggctatagggcttttcgatactacaatacctgaaaaatgaaatactacagttataatccacatgataccaggtatgaaacattcagtagcagtgggctagagctacaggttaccttcttgagacacgttgtcaaagaagaccatagcactaggtaattgggaaatccagttggaactgtgtagcagacactgcccactctgttggtttacctctggcttgatcagccctgtaatggagagtctcgggcatgctaacagcccaccaggtcaagcacccactgcttctctgtgtttcagcctcacgactttgtccaaagttatagaaactcactcatccaacacacaggaggggacctgatgtccctgagaaataattaatgaggcacaggaaccagagacatattccccagcctcttattcttcagagggacaattatgagtacattctacagcattcctcagaggggtcttcacaggattgaacaacagtttcccactgcagtagccagctgaataatacactcactattgttttcccccgtttttccttacttcccctgcctcccacttgtgctccctgtgatcagctaccaaatgagctagttgctctctagtcctcgcctcaggcttagcttttaaagaaatccaaactaagacaaactgtgacaaattacaatccaaacgagattctttcctctcagggggatgcttagtccccccatcaagcatcattatcaaaatgaacacagactgcagaggaagaaaatatttgccttcactgagcaaagtcagactcatgaccctcaggttagagacacagagaaatgcaactaactctggggtgaataggtacagattcagagtggaaagactttaaaacagcaataaagtcctagaaataaaaaaagctgtcagctcggtacagaccagagcttgagagcaagagtactaagcgactcatagaaaaggattcaggagggaccagcacagcgactttaggctcatagtaacaagcaacagtttgctttggctaaagtttattactaggtgtggacaagcaagagataaatatcggaatctgtgggtacagcctttggatttcatgccatggcaaggtaaaatccatctgcaacatcaaaaacagagaggcatttgcaaaaggaaacatgaggagaatgttcctagcagcactgcccaaaataacacaataaacgaaaaatcttcgagcagcccaaatgccctctggcaggaaaatggacagttaacctgattacatagtagtcaaagaaacgactgctacacaaaacaatcaagataaattctagggatgggatgatgcatgaggaaaatatgagtcccaaatatctttttaataacatttaaatataaaaacaaactaaaacattttgtgtcatacagtaaatatttttaatgttctcacatatgttcacaatagccctatgacatatttactattattgtccccattttttttttggatgagaaaactgaggctcagagaacttcagtaacattcccaaggtcagatatccagtaattagtgtagacagaattcaaatccaggtggaaatgctctgaaacccacagtcttacctgctacactaaactggaacaaatattgttgaaacatatgtatctgataaaacatttaaaaatattacaggattataaattcaggcaatgtttactatcccaaagttggggggacatgggaagatggcatgaggaagctgtgctttatgtcattgccaactttctagtccttcagttggtggttaagtggagataaggatgaggccagagaacatgagtggcacgaatgcaagattacatcttgtattctcttaaaattttaatattttgctcatatgaattattttgcattgattttaattgttaaaatgaggtaaaatataatttatcctgatttctgaatttttaggcgaccgcttacattttgtgattcagacatagccatcttttctgggagaggaaggggaggaggtacacacaggatttgtcttgaatgtaggtttccctattttcagagattgtatatttgcttcctgtggcttggtgtgaggtctgatgaatgttaagcgaaggctaaatcaccccctctctccttagtaccaccactgaagtcacttctttctggccttaagttcaaaaggggaaactgaatgatgagtattgagcatctacactgtgtcatggcattagtaattgttcctcacttgactccctcagtagctacataaagtaagtcttcttattctcatttcatggagtaagtattcttattcccattatgtggaagaataatacttaaagtattcttattcatgtattaaaaactgaggctcagaaatactaagaacattgtctaagggcaaatatttcaagtgccataaattcttaaacttcatgggtattttgtatgatttttcttttcaacctcttttgactgggctattctgggaggtggtcacagctattagggccaaatgaattaaaatatatgaaaatgattgatgaactgtaaggcatcatatcaacataaatatagtataattaataatgtcaataataaaatcatttacttctacttctagtattcagaagagaggtaaaggtatattttgcctattttagagtaccatatgaaatgaaataaaatattattatgaagaaaaatttactcttttcacattgggaaactatccatcagagtcaacaatcattgtcctccttctctccaaaatagaacatgctgaggtttatgctatatttttgaactatttctattaacacaattaaaatgctgaaatgaatttgaaaagatgtttatattctgacgaagggtaactagaaatattttctactctaaattgagtcaggtgtgatactgtaaacaggataagtaaaaatataatataaaatttcaaaatttactacttgattccaatgtccagaaaagaatgaaaatataaatcatataaaactctagccaatttaagcaactgtaatccctttagacatcattaaatttactttacctctgacagtaggtgataccataaatgagtaagaacatattttaaatgtcaatatattgtctctctggataatatatttgatggttttatataccttactaaaacccatagaaactttttaaagatgtgatattagtgttgatatctattgaagatataattggctaaagtttaaaaaagagtaaaatatttttttccaagcacagcccagtaatattggacatgtgatctttgttttttactgttgtcataagcatatagaaagacaatttagcaagtgttctgatgaggtttaaagagcattttttctagtatatggtagtataataaacaataattcattgtatatttcaaaatagctagaagagaataattataatgatcccatcacaaagaaaggaaggattgagatgatggatatcccaattactctgatttgatcatttatacagtatatacatgattaaaatattacatgtgatatactttggctctgtgtccccacccaaatctaatgccaaatagtaatctccttgtgtcaggggagggacctggtgggagatgactggatcatgggagcagatttccctcagacttttcttgtgatagtgagtgagttctcacgagatctgatggtttaaaagtgtggcacttcccccccccccacatcccccagctcctgccaccatgtaagatgtgccttgcctccccttcaccttctgccaagattgtcagcgtcctgaggcctccccagtcatgtggaactttgagtcaattaaacctcttttctttataaatcacccagtctcaggtagttctttatagctgtgtaaaaatgaactaatacaacatgtaacacgaaaatatgtacaactatgatatatcaaaagctacaaactatttttgtttgctcatttactatatatcttagatattttggaaccaccaccaccacacatcacacacaaattcacaaacataacatgttataaaacataggaaatcaaatgagaacatttcctaaggctatgctttttcaactggtagttggggaggaaactgaatttcaaaatctccgctctataatttctctctaactctatattgtcacttctggggaaaaaaagagaagaaggtaaattgcatcttctggctctattcagaagaagaaaaaatggttggtgatctttgttgtatggattttatctgatgggtctcctagtttacacttagatttgctgaataaatcctcctcatttccagaaagacaatatggctttgtgggagtgctgaaggcacatctttgtcagttcccactatcggagactcccagtacatcctgtcatgccaggatttgctctgcctgacaagaaggaagaagcttatgatagctttctgaatgactctgaaaaatgaagctgctctgcaggtatcatcactagaccacagataaactcaataacattcatctgctagaaaaaaaaaaaaaaagaaagaaaagggttcacttccagatcagcctttggtagagataggcagtagggacttggcagtccctagtcacattcaaatgaaggttcgacctattgtgctgaagtctaagacaaaggtgcttatttagatttcctattttatggctaaaatatatgtgactgtaggaatcctctgttggacatacgcatacacaccaacttatctattgcaagggtctatattattagtatgactgtatattaaataattttattatctgaaaaatttgagtgcattgaagataaaactgactcctgaaatctaagtcctatttaatcaaaacttgcttcaaaaccttcccaaagtttcaacatgtattattttttcgtgtgtgtgacaaggtcgcactctgtcgcccagatggtgcagtggtgtgatctcagttcactgcaacctctgcctcccgcctcaagtgaaacctcccacctcagcctcccaagtagctggaattacaggtgcccaccaccacacacagctaatttttgtgggttttgcagagatgaggtttcaccatgttgtccaggctggtctcgaactcctgggctcaagcgatctgcctgccttggcctcccaaagtgctggcattacaggcatgagccactgcacccggtcaacatgtattcttaaacagatttaaaatgctttcttcatagcattaaaaatgtttcacaataatttacatgagaactctatggaagcttaatatatttccagcataggatacacacaatgattcaatgtcctggcccttgaagtacacataattggaatgaggagaaggacatttggaaaataattaccatgcaatatgatacctgctattgtacaggttcttacaggtgctacagaagaatcaaaggaaagggagactaattccacctcagagaattaatgaaatgtatcacggcaaagatcagattttgtctgggtcccaaaggacgttcaaaagcttggtaggttgagaaagtgggaaacagcattccaggtctaaggagactgccttaaagtttaagtaggacagtcaaagagtggaggaaataagtcaaaataggaaaatgacaaaaaatagagaaccttgtaggccaggcttaggacttctaacttaagacaatggagatcatcaaagaccctttagatgactaagtctgagagcagtgtgtaaaaggattggcttgaaaagatcaaaatcaggaagtccagatagaattgagaagactatggcaaatagtgttggttgatgaaaaggcattgttggtattaatgggagattccagagatactatccaacctgttttatacttttttgatcaggttgcatgtctaagaacatccctaggaagtattacttttcactgcattattttttactattcaactataaagtaaatggatgcatgtaactgttgagcctttccttgcactcatgccataaatgtaagaacataaagctacaccttaaagttaccttttagctcttttattttttatgttttagtagtattcagtctattctactgaattcagtcccgatttgttatattttatttactcttcaaagaaagtttttcaaatgacaattgaaataaaagaagataccatttgttctgtagattatctacattccaattcctatttcctaggttccctattctaatcatctacttttctatattttcttcatcaccaaatacaggcagtcacaggcaagtgcaggagttaataatcattgataaattacatgttatatagactttgatattcaatttctctggagatatataactatatatacccttctttccctcagagggctttaaggaaactaaatccccaaaactaaaagcactgactcatggtttaaagggtaagttaaatctctctgtaaaggaaagcctaaatgtgatctttgcaaacataactggtgatcaatagccgaaagattaaagcagtacatatgcaaaaaggaagattgaaacttaacattttgtttattgatgtcattcttagatctcaattaatttaatttgatacatcaacctccgtcctcaatcaaacactagatggataaagataatcactattatgtaatagtcaatacgcccaggtgtctcctggcatatatgatctattgaaatacatatattattatattttaactaagaaacacagtatctaacccaagtattatgtacattttttaaacaattcacttccttgaaagttatgagttaccaatcatttttaataaatttctcccagctttacatttatctatcaattatatctgaacttcaaatacactctggatgcatttgtctcagagcaatgatggtgtctaagcttgcagtttctgtgtctgtgaaattcatttgcagtaaattgtgaataaataaatgcagtaaaaagcctaggctccttggagagtctacattctcctccctcccatctctttctctcttcttctctcctaccctctcatcctccatctgtccctttccctatccttcttatcacacatgggaaaaactcaattgaattaaattcagtctaccagaagtatacaattgaatttttgataaacacaccagaaattagatgtgtatgttcatttattccttccgcacatatttgttgaatgtttacttcatgccacactatggatcaagcagtgaagataaaacagtaaacaagacatgcaaggaaactactctcatggaacttccaatctattgtagggaatagcaaataaatgacaaaataacataatcacccaatataataagtgttattgaagaaataaacaagatgttcagatagaaagtacctaaaatagagagtccagggaaggagagagaactagtctggatttcatagtcaaagaaggtgtttttttggatgtgcaattaaacagatttgaaggatgaaaattattccatcatgcaaaataatagcacaagtttgtccaggaaagagcctttgcaaattccctgggatggaatagaggccttcattactgtttggaacttctctcttcaatctacctttgtagcctaaaaggcatttttaaatatggtcaagaatgttgaaactgtttttcttgatagtgtaaataaatgtatgaactactcaaacaattagctatagtgataaatcgaataagttggtaggtttgaatatgctggataacactgtttctgataccacctagagactggttcccatctgtcaactggttataaaacaattttggaaggaatattataacttgcaaagaaaacgaacagaattcagagaaaaagtaacaaaaattgctcttaaatatttgaaaatatgttcatcctcattcctgagtagataagtgcaaactaaaagacatagtttcatagtttttcaccaatcatattggcaaagatcaaaagtttggtagtatactgcgttttttatggtatgaggaaattgatgttctcataccttcctgacagatttgaactgatatacgtggccatgtgtatgactatgcgcatgtatgtacagcagatatctgaaagaatacacagaaaaccgcaatgccagcacccccagtaagagagaaggaggataactaggaggctagctaacataataggagaaacaattttctttatgcgttcttttttgtttacctctatgaattttgtactatgtgcaattaactaggtaattggagctttaagagcactttgggggtcattaacactaaaaatattttacatagaaataattataagcatattcatccaaccatttatttatttatccatgcacccatccatccattcatccatccatccgtttatctcttcatccatctcatgtttaatttgtataaacgtttatttatcccatagactctatgtatgtatggtacatgtaaggttatataagagatacaatgttaaataaggcagtttctactatccctaaatttacaatgaaggagaaaagctacctcatgattacagatatgaagggtttggtaaatgcatcaccaaggcttacacataagcagaaggagagggtgcagagagctaaaaggctcccccaaaggactgaaacttgaaaggaattctgcagataggtttgaaagccctgacatgatttttttttttttttactgtttcctattgcatattcttttgtccctttcaagtatgaaaattcttataatttccttcaatgtatactctctaagtaataaaaacaattgtattctcaaaagctaacaaacaagaaagcaagcaaacaaaagttcaggtatcacatttgcagtaatatacaagtgctttcattaaaattatgcttttatgtgtttacttagaggagtcttgagaaaatatttagacctaccccctaagctttagggaagtggtccccaacctttttagcaccagggactggtttcgtggaagacaattttttcacagacttgggctggggagatggtttgggaatgattcaagcacattacaacatttatcattaaattctcataaggagcacacaacctagatccctcgcatgcgcaggtcacaatagggttctcgctcctatgagaatgtaatgctgctgcttatctgacaggaggcagagctcaggcttgcccggggctcacttcctgctgttccccctggtttctaacaggtcacggaccgattggtctggggcccagggtttggggacccctgctttggggacccctgctttggggagaacagcataaaaaggcagcatttctgaaactgttctagatttttatttttctgtcagtaaaatggttgtagtattggtatataaatcttacactgtattgtagagtctcaataaagttactcactgaatgaatattttaaaaagttttcccttattaaattacaaaagtaaaataggagtactataacataatctacataaataccaaatatgaattgatatatttttcctatattttaacagaaattcttcttgagagaaacatagaattctatgtctcctatttatagacattaactgctacattttgcacaaccacttttaccgttagaaagagaactgtactttgatggttacatagcaccttttcctcatgtacaaaatactaatgctactaacaaaaataattttaagtgatcaaaatatgaaatgtaattatcaaaccccattatgaggatgaggttaagataaagtaaaatcatctttgtcagggtggggcgcagtggctcacacctgtaatctcaatactttgggaggccaaggcagggggatcacttgaggccaggagttcgagaccagcctggccattatagcgaaaccccatctctactaaaaatacaaaaattagatgggtgtggtggcacacccctgtaatcccagctactcggtaggctgaggtgggagaatcgcttaaccccgggagccagaggttgcagtgagccaagatcgcaccacttcactccagcctgggcaacagaagtgagatcttaaaaaaaaaacaaaaacaaaaacaaaaaatcaactttatctatgctttgctataggtgttaacgataattgcctattgtcctacatggatgattttattaatagtgattacataaaaaaatgaaaaactttctgtgtagtggtgatgtaaaaagatagttttcatcacatggatttgttatatttttaaaaagataattcttcataggtttttcagggattgtctggttttatttgtttaatgaaaaataaatgaggtaacgtctcattgtaaaataagagtttaaattttaattaggaaaagatacccaagacagaaatacatttaaaataagatagattatcacttttaattatagaaaatgaagctttccagaattatgtttaaatttatagatgcattaaaaactatcaagtttaaacatttaagtacctgaataatgttgagcaaatagcaactttggactatgctggcatgaggagagtgaggaaatgccacgataaaaatcagaaattattaaagaagtccttgctttcttttgcttacaaaagattctattgatattgaaaaacaaaccaaaacaaacaaaaaaatggctacggcatctggattcaaaatgtttccataagtctatggatgcaaagtgagtctcaattttatgaaataagaaaaaagaaaaatgttagctagaccaggcatgatggatcacacttgtaatcccagcactttgggaggctgaggcgggaggattgcttgaggccaggagttctagaccagcttgggaaacatagcaagaccctgtctccacgaaaaataaaaagaaaattagcagggcgtggtgtgcacttgtcccagctactcaggaggtgcaggtgggagaatcatctgagcccaggaattcaaggttagagtgagctatgatcatgccactgcacttcagcctgggtgccagagagagatcttgtcccttaaagataaaaataaaaaataaatattagctaacctactagttttacctgagttccttcagtggattacaacatatttcaaaccacagccctattgaagttaatttctgtgtgatggaatttattagctttatgttttaaaatacactgattttctcctctgaaagagtgagaaaatattctttagaaacagtttacattacaaactctgatgagtggatatgaatactttgccaatgaaatgtgtgtggatacttggaaattggctgggacatgaataaattgctcaaccctattactgtacacactgaagtactattttttagtacttcagcagtaggtcagcagtagaatcctcatatccccaaagaaagaacattataaatatatgtgtaaatttttagcataaaacgtgtttaaaataaaatattaagatggaatattaagtataacctgaatattaagaacagatacactcggaattagtggggttggggaaaaagtagaagacagctctgtggccgatggttttggtaataatgtttagggattccaggaatatgattttcaatgtcatagtatttttccaaatgactaagtaggtttttcaaaaactctgggtttttttttttttttttttttttttttttagaaaaataattgatggactcaatctgaaagttattttggcctaccatacaaagcctatgcagttctcagtatgtgacctgctggaatgagtgtgaccacctcagtagatactaacgttgtactggcaatacttttaagtttaaaaccacaacattgtattccggaagacttctattttgagtcttttcattctgatagtatcctccaaggaactttaaagaatagaacccctgattcaggtaacaagatctgaatgtttgggatgcatcagtgagtagaagcaattcacgcactttcagaagtccttaacttttgggcccctcaagtaactggactgtaacttgaatccagtaaatgaactacatgaaactgtcaccaaactaaagcaattgatgaaacagtaacacgaataaatataaaaggcactgctaaaaaggctttaagaaaggctttttaacatttttgagggaaatagtatgtaaaagtgtagtacatgataactaaaattagttaaattaattgcaggagttactttaatcaccacatgtctacataacaatctaaactactaaacgttataatcttcaagaaaaggctacaactatgaaaaagagcattggtgaatgtattaagtttgatagtaaaaacaaaacagacaaattaagctgatttggccattgattaacttttggatattgggggacataaatatttatggcttgttttctatatctttaaattgagtatggatccagcaatcccattactgagtatgtatcccaaagaaatgaaatcattatattgaaaagatatgtgcactcccgtgttcattgcagcattgttcacaatagccaaggtatggattcaacctaaatgtccatcaacaaatgaatggataatgaaaatgtggtcacacacacacacaatggaatataattcagacatgaaagaagaaaatctaccatttgtgacaacatggataatcctggaggaagttttgctaagtgcaataagccaggcacagaaagccaaataacatatgatctcgcttattataggtggtatctaaaaagttgggctcatagaagtagagagtagaatagtggttaccagagactgggaggagggtgtgaggcttgcagagatattgatcaaagaatacaaaatttcatttagacaggagaaataagttcgagagatctattgtacatgttgattctacaggtggttcataacaatgtattatactcttgaaaattgctaagagagtagattttaagtgtttttcacttggctgggtgcagtggctcacgcctgtaatcccagtactttgggaggcggaagcgggcggattgcctgagctcaggagttcctgaccagcctgggcaacatagtgaaaccccgtctctactaaaacacacaaaaaattagcaggatgtggcggcgtgaggctgtagtcccagctactcaggaggctgaggcaggagaatcgcttgaacctgtgaggcagaagttgcagtgaaccgagatcaagccactgcactcctgcctgggagacggagcaagactccatctccaaaaaaaaaaaaaaaaagtgttcttcctacaaaaaaataagcatgtgaggtaataaatatgttaattagcttgactgagccattcatatatatatattcaaaacaacatgttgaatgaaataaagataaacaattttttctatccattaaaattaactatttaatttaaataaaataaaatggatttgatcatcctaacacatttactaggttgttataagatctaaacatggcatcatctgcagaggtcttggcttaatgtctgacatatattaattgcttagcaaatcgtagctgtaatcactaaataaataaatttattgacttttttattccatagtacccttcgctacattatttgtatctctacttcgtctactgggaaggtatgcctgtggcagaaaagtttccatcttatctagcctttctcacattcccttctgtccaaatcattccagcccactctgaatctaacttgttttgacagagtacttatttacttggcacatgataggttcttaataaatatttgtttattgccttataggaagaaagttatgaaggaaatataacttgtttactgaggggtagcaagtttccttctttctttcttttttttttttttttttttttttgatggaatttcactcttgttgcccaggctggagtatgatggccagatctcagctcaccacaacctccgccttttagtggagatgatgtttctccatgttggtcaggctggtcttgaactcccggcctcaggtgacccgctgcctcggacgcccggccgcaagtctttcttttatcttactaaacacagacaaatgatggagaaaaagtctgttaagcaaatgcatactgtcttggattatttaagttttcgggtatttaggttgatttcccaactaggatatcctggaaacagatttaatgtaaatcatcttatcccttcaatctttagattctgtattaatctttctaaaaatttgctcttatgttcttctggaacatttatatccctaatagggatggtaaatctgataatctgatattcaaggtagcatggtgcacacacggattatttgatttagaaaaaaaatagacatgtgtttccctaaccgcttgtaaaatgcagcatgtatataaatcatctcatgtattaggcagtttccattttcccaaaagaaaatatgcctgtgagccctcaaaaatattttaggccaacatgtatacacaaaattttaggactttagcaaatatatataatcaattgtatgcatgattttgataagaaattgatgccattaattttctatgataaaaatattaaatatttttatatttcatatttatatcatataaaacattagaaatattagaaatgctggcatgttttttagtctcgcatttcatgaaatgactttattcgatctctttgaaagctactttgaggtaatttttttctttgtcataagaacccctttttttaatgtcatctagaagcttttttcagaacccatcaactccatttccagctacataagttgagataaattactttgtgaatatgtatgctcttcgtcataaaaatttgacctcacgccacactctgcttgctagtaagaaagctgttgtttatatttttccccttgtcttttggtgtatatttgtgaattcaatagcatgactgcttactgttttgtatatgtggatacgtaggtatgtgtgattttttaaattatcattaacaatgacacctagcaagtaagaagatgaagtcagatacctgggaataatctaacattcaatatttgccttcagtttttcaatccgtttcatcaggtaacctacttacagatgtaaaacttgcaatgatttgtcttctaaacagtattatcttattcagagtaaagcaattgagagttctttctaaaataagagatttttaaaatataattaagcaactttgaacaaattcacctataaggagacgtaccagttataacactgttaacttacatggggttggggtaattgcttacaatcagatattctcagacattacaaactttaggttgcagtactacaaacaaatataatgaaaacggtgaataaacatttgtttatgcatggctttattcttttgttcaccaattccttgttctgtttaaacacattccaaaaacatttacccataacgtaaaggaaggtatgcatagatataatttcaaacattagtcaatagcattcagtgactgaatggatttcgggatggagaaaggaatacaaaaataagcgacttcagggatttcagatataggagcctggaagcagtggtgcttaatagaaaggggaaagagtcatgaagagctggtttatgtgggagtagataatgagttccatttggtatatttaattttgagactgatggggggacacttaattggagacgttctgtaggtgtaattatattaagaaggggaaaaattcaattagagctccaccaaattatatcagctgtgtccaaaccatattgattgcctgtgtgtatagctggtgtgcagtgtagcagagctgaatgctactaagctcccttccgttctacgttttttgatttgaagaagaatatggagggtgacatgctggaaagaggacatgaccagcagctttctctctctctctctctctcactgttcctctggtttctcctttgtttcctctactgcaaatggataatactgtgccatgttcaactaattggccatagttactgaggatatcaaaacccatcaagcacagatacttttcttttatattattattatattttaagttctgggatacatgtgcagaacgtgcaggtttgttacataggtatgcacgtgctatggtggactgctgcacccatcaacccgtcatctacattaggtatttctcctaatgctatccctccctttgccccccaccccctgacaggcccaggtgtgtgatgttcccttccctgtgtccatgtgttcttgttgttcaactcccacttataagacagaacatgtggtatttggttttctgttcctgttttagtttgctgagaatgatggtttccagcttcatccatgtccctgcaaaggacataaactcataattttttatggctgcacagtattccatggtgtatatgtgccacattttctttatccagtctatctttgatgggcatttcaacttacaatgaagttacatgctgatatacccatcatagtttggaaattttgaaacttgaaaatgcatttgatacacctaacagactgtacatcataggttagcctagcctatcttaaacatgcttagaacacttacgttagcctacagttgggaaaaaaatcataaaacacaaagcctattttataataaaatgttgaatatttcatgtaatttattaaatactatactgaaagtcaaaaccagaatagttgtataggtcctcaaagtatggtttccacagcatgagtatcactttcgcaccatcctaaagtcgaaaaattgttaagttgaactactgtatgtcggggaccatctctgtacttgaaagtagtcagaaaaccaaaaaagtaataaaaatatatgatacggtattattattattattattaggtctagtattctacttagagaaagaggaacttccactaagtatctggattaaaagaagcttttgttatttatacaactaaaacgttgtagaaattatttcccaactaatcaagacgcttttaaatgccttcacaatctaatcataacctgcttttctagccctatttttggtatttcacccaagcattcaagatttcagaaacatatagctacccattgtccttcccagatactatgaaattacattcctttaagcttttgtacatgttggtccctccctcctggaatgcaacccctactcctccataaccccaattcttcatttgataaatctttacatgctttgagatttatctcaaatattaccccattcctcctaccctaagcaaaaccattcatttcttttgcattatatatatttactattgcatacacaaaatgctacattctctatgacacactatactaggttgtgaactcatcaagtgcactattttttaatttttccattctttacacctaactcaagtctatgcatatatttttctattatatgattcatatattatatattatacatttattatatatattattttatactatattaatacatattaacaattaatactatatatatttcatatatgttaaattatgcattttatcttattacatattatatatattcatatgattcatatattatatggattcatataggtttgttaaattaacagtgaaagccccagtttttgaggaaattgtatgtattgcctatatcttggcagtcaactttactaataagctgctataaaataaatatgattcattaagagtgtaaatggaatcctaataaggagataaccctaaatttacgatagtcaggcatgttgtgcaacagagaaactgtattctgtaattgctagggggagagtgcgtggttactgtcgatagttgcgttatttagatcattacattgcataagtaatgtatgcccatattgatgtaaacgttatgcaggtaatgcatatttattacaaataaattagaaaatagagtaactgtgttattctgatttgctgaatcttttgttcacatgtaggctgaggtataaatcaacagaataaaagtgtttttatggctaaggtcagtgagagattcaaacaaacgtataagcatataagtgtgcttatataagtatgtattcatagtcacacacatatactcacatgctaacgtatcaattgatttaaagttaattttatagggggttgatttgtcacattatcaaacactaaagaatgtatgagtttttaaaatgtccatgagtgaagaccaaatgccagctaactgagtgtaacatagaatataggtatattgaaagtattcatatcaacttatatttcatcataaagctgtatttcattttaaggtttgaaactccaatatctactgtgtcaaagcagattgagtatataaaggaaatgggttcagtggtagctatgacaaattaaattttgcctgcttctgtaaagtggaaagtccctattcagaaccagacaattgttactagaactaaaatgagggtctagaaaatctattcaaatatacacacacgcattatgctaaacacaaacgtatctgtccttatcaagtaaaaataatgagcaaacatctgtgcatgaatgtaagctcagtctactttatcagggctatttccgattttggctgatagatcagtttccttattgatatggctacaatagaatccatttgaatgagattttgtaaccataaggaattgtattttgtaaggtggggtcacaaatcctttcctgtttcaaactgattaacactgatactgctcttttgtgaaaattgcctgtgtgcaggaccatatttgaaaatttgaacaataaataataagcatatgtaataaaagtaatagcgatgtgtgtcatattatatatagtttccgtactcccctagtggggtgggtggattttattttcaggggaacttccaaccttataaacaattcaccaatacattttccatctatggggtaaaaatgcaataggttatagccatatagtttacgccagacctctaaggcatttggaataaaggtagaaaaaaagggcaacatttaatatttgaataaatatcataagggtgaagaaaggagagtcgtgggtacatattgagagaaaagtaattataaattggtatgactagaagagaatggcaatgagctttggcaaatgatccccattatagtgtagtttaaacgattgatgtacaagcccgaaaaggctggagaatatcagatctgctggttacagggtgtatctgactaccagtttcagggtacagctgaaataaatcagtgatcccagaaaagaagtttctttttacgtgcaaaacttctgagcaaagtgatctctgccagctggagctggggattcacagcctctatttttccatcaaaagaattaagttgactcccagatagagaataactatatattttttttcagatgtagcctcctgagtactcaaaaccatctccaggatatggaaaattcaccttatccaaacgtatatggctaaaattcctttgtaaggcactacctatttccctgtttcttgtatttgattagagataactattgagaaaacatggtttatgaaagaaatgggaaaatattttcccgttttgataagaatgtatttttaaaaaacaaatggaaacctaaagacacaaaaaaatatttgtaaaggggataataccctgagggaagggagccagaagtagagactagagatattaagaaaaactttaatgaatttatattttggctcagagctcacctactaagggagtaaacaggcaaagtcacaaaggtttataatccttacacttgccattggtcggggtaggtgattagatgtgaaaaaaaatgatgctttatttattctgggcatattaaactgaactgggtgatttaaatgaactgtaggaaattcaatgcaacagctaaaatgaatgactaaggagctagaagatcttaatctgtataaagctgaaagaacaaaatatgcacaatttagctctgtgctaatgaaaggaaagagataacactaaaaataactgaatggtgcaggcttcaaggcagcagaagagttctggcacaaatggatctatccagaaaaaaatgagacttaattacacaaaggaaaaactgttgactgtgaggaaaagtgtcccaagatgaaatgactgctgttgaatgggaaaccatcagagaggcagtgacgagagtgttatctcgacaactgaagcagctgaaatgagacacgttgccggaaaagccattacagactaaataccccctggtcctaaagagatagatgcacatcaacttaaggagaattgcagagcaggcacaccactagaacacggggcagtgagtcaggagtagggtctttatctcaatgccattaggtgtagtcttgctcaacctaatttatttctgcggcttggattgctttctgactattctgcttcagtggaatgtcgttgtgaccaattttgttgctactaaaatacttaagtaacaaaatccacttcttgataaagatttaatgtcatctaatccctaagagttaaggacattacaaagattatcagtgaatcaatgaatattggtagtcatcatcaaaaaacaataggttgagagtttcagtaaaactaatgaaaaccatatataagaacattataaatatgattacaatagatgcatctcttttagaaacaaggtaataaacactgtgcttccaagatgtatttaagaatgttgaaggaagtgaggcacactgacttgtgcctataatccccctgggaggctgaggtgggagggttacctgaggccaggagttagagatcagcctgggcaacaaagagagaccatatctttaaaagaattttgttttagttagccaggtgaagtggcacccacctgtaatcccagctattcaggaggattgcttgaacctaggggttcaagcctgggtgacagagaaataccgcatctctaaaaacaattttaaatttaaaaatagaaaaaagcatgctacactgggccccaagatctatgcttgcctccaatttttccccaatttttatgatttccctttgtgtaatgtgatatttgatgcataaaagaatatatgtaatggatatgtaaattacaaagctcaataataaaacaaacatatgtccatcccaataactgaaatattagcaacaactcacacctgaacctatgtgctcctacactagttcttcactcttttgtacccctccctccatttacccaggattaactaccatccagaatctggggattgtcatatcattgcctttgatttcttttgtttgctcatttgttttgtgttggttttttcgatttatcacacatgcatgtatgccaaaacaatattttcattaggtgttcctatgcttgagctttctggagtgttgtctaatacaagggtcagcacactaccgcccatgggctccccggctctggagtgagtgcacttccccaggctggagcgcagtggcgcgatctcggctcactgcaagctccgcctcccgggttcacgccattctcctgcctcagcctcccgagtagctgggactacaggcgcccgccaccacgccccgctaatttcttgtatttttagtagagacggggtttcaccgtgttagccaggatggtctcgatctgctgacctcatgatccgcccatctcggcctcccaaagtgctgggattacaggcgtgagccaccgcgcccggcctccctgacagtttttaaaaatgaagttttattagactcactcacacctattcactcatataataactatggctgctttgatgccacaacaacatagttaggtatttgcaatatgacctagaagcctgaaatatgtactatctggccctttaagaaaatgtttgtggacctctacattatgtttttatgattttctcatattcttacatgtgatcatagttaattatttatactgctatataatattccatggtatgaccataatacaattatttgctattatgaacactgtagctacgaatgtccttccctccctctctggcactggagacactcagtgtaaattgatttcctaaattaattctttaatcctttttgcgctgaatatagaagtcacaaagtcacacaaacattaaagaatatttggaaataagagtagagtacagaaaatgcaaggaaaaaaaaacaattctatctctcccccttagacaaccggtaatactaatgttatgcctttttcctcttgctgtgaaactccttatccattaacagctaaggaaggatcactgtcgcctcaccttcctttttcatcctgcctattatgaataatccataaatctcattttaatgatttcactagaaagcattaaatgtaaataatccgtgggggtggacataggaggtaatattagacgagcaaaaggaagaggcaagatttaaaagaccttattaagcttttaaaatgttttagcacatgtattctgttcttaatatttcacacacacaaaaaaaactgtctagaaaccacaggtgatttcataactttacttgtatctcttttttttttttctggagacggagttttgctcttgttgcccaggctggagtgcaatggcgccatctcagctcaccacaacctccgcctcctgggttcaagagattctcctgcctcagactccggagtagctggggttacaggcatgcaccaccacgcctggctaattttgtatttttagtagagatgggctttttccactttggtcaggctggtctcgaactcctgacctcaggtgatctgcctgcctcggcctcccaaagtgttgggatttacaggcgtgagccaccgcgcccagcttacttgtatctcttaatcccatcataaaggggcatatcctattactttaaaagccaacaattccctctcattttcattcaccatgagttactactactcctgaaaccttcacaaagtttcccagaaacaggacagcccactcctagcccatgggcctcttcccttcctcatttcttacccttttcttcctccctgctttttttcttgaaataaaatttccccaaaagctagtctgccactgcaagcacatcctcagataactggataaaggaagataatgtggcacagaggagtctggggatacttctagccaaatagtttttgtgccataataatctttatgacagtaggatcctgaaatgttacctagaacacttgtgcctagtcccaatttctggtgggataaaactgtatataagggaatcattacaggtgcttgcgtctgagacacttctggctatgattgagtctcctacacattatcaaaaaacgtgtaatgctttaataacaaaagtaaatgaaaatcctcaaaggagttaatatgctaatgtacatagtcactttataagagggtagtgtaagcaaattatcccacattaactcaatcagagtcccggtagaaactggaggattgatttctcaatctcggggtatgtgaggccagtttgctaaaggggttatcaacagagatatgctcagtgttaggaaattcaagaagggatgacggagagttaactgtagacctcaagggttaagaggaaggacgtttcctgaactagagagccagacccaatagaaatgcaagagagaactgtccagcagaagctctggtctaatgttagctgttcagagctaacctgtggaaatcccatggggccacatgaaaataaatactccacccttttcttatccactgtactcctcctgctgcagcctgtctcaactggaaactgtagggcaaaggaactctgatgccattcctaaagggcagtccccaggacacaaagcacagtggtaaagaatgaaaaatggatttgaaaggacaagagggaaagaatttatgcactaagcataacttttccctttcaagttaatctagtatgttgagttggtttgctctttaactaaacccccctgtttccaaagcctgaggataacatactacctactgagttggtaaacaaccttaaggcagcagtcctggagcctagacagagacattggatgagtagacgaatggaggtacacgaggtatacatggatggatgcatggatggataggtgaatggatggatgaagtcaatcacattagtattttacagacacacgttacacaacctgtatctgaacacgatgagtctctcttcctcctttgattatggaagttaagagcaagcactgaggtaaccaatattatatagatttctggagtaaaacaggtactcatcatgactatcaacgatttgaatttggggatgatgtcaattattcaaagaacctgaaaaaagtagtgaagttgcttatctgaggccccagaacttccttcattttactctggctttcaacgttggatacacattaaaattatctaggaaacttttcaaactgagatgctcggattacagaccacttaagtcagactctgtggaaatagaacgcagatatcactgtttgtaaacactccaccaatgtgtagcaaaatgcgaaaactactgatctttccactctctttaagatctaccattatgagccccaaaatcattctggttctcttggtaatttacattttttaaaggaaactctaagatgccttgctgataatattatatatgaaaagggttatcgaatttatcgggtttggggttgggggaaataatacttatcaaaggagtaaaaatatgagcagttcataaaataacctgtgatagtccagattacttgcatattttcccttgcatttcagagtccttatcagtattcaaaggactgtagagcttttagaaatgcttcagtgaggaacactttatactctgtccctgataaatgaaagtgtttatttcctctcagataagtcagtaacaagcaagtattttctagcaactggactatacccacctattcatttcccaaggctcattgggcatcactaggaatacaacaggttttagttactaccaaccccagttactgtagaattaggcaattatataagagtttaaaaaatcagtaaggatgtttttattttaaactacttggataattgaaaagtaggtagacaacatttattttttgtctttatttgccaaacgactgtattagatttaaaaccagaaaacaagcccctatgtagaatatagattctcaccagttcatagatcaagtaataagacatttcctagggtgtttaattgtttgatactaagagcaataaattataggaaaataatttgtaataattggttaagtaattaaccacaattaagaaaagatgatggaatccctgaggatatccgacaatactgacaacattataaactttaagagaaaaaaaatagttgttgcagagcaagaaaagtcatcatgtgcctagcacaaatagaggtctaattataggggattttacgtttttcataatgtctacaatgagcatatactacatttataatcacgaacagtccattagcaggtatcatatatctgagttgggaaataccctgtcacttcgctaatacttctttctttttgttctaatagtgtattcaccaaataatcttctaaatatatatgtgtatatatatatatttgagatatatatgtatatatatttgagatatatatgtatatatatgtgtatatacgtgtatatatatatttgagatatatatatgcaggaagaagtgagtgacattctaagaaacactaatgaccaaaaaaccacataatatcttttcttagtggtgttccttccttatattggccaaccaccttgcaataaaaaatgatgatgtagacagaaaggaaaagttagagctacctattctttttcctttccttttagtccctccttacacgtcagtaagccaaagggcatcttcttgataaactgtacatttatgaagaaaggaaataaaaaccattaagttcattttatgcagcatttccactattctggtaagtaaagaaagcatgtgtgtggatgatgtatgaaatacaaattgtgtaatttctatgactctccatataagttaaatattctcatatatccatctaaaaatagcactgacttcagtaaagtttcaggaaacaaaatcaatatacaaaaatcagtaacatttctacataccagtaattttcaagctaagcaccaaatcaagtatgcaatcccatttataatagccataaaaaataaaagaggtgaatgatctctatgagaagacttacagaacactactaaaataaatcacagatgacacaaacaaatagaaaaactttccatactcatggattagaagaatcaatatcattaaaatggccatactacccaaagcaatctacgaattaaatgttattcctatcaaaccactaacatcatttttcacagaactggaaaaaagctatactaaaattcatatagaaccaaaaaggagcccaaaagtaatcctaaggaaaaagaacaaagccagaggcagcacattacccaacttcaaactatactataaggctacagcaaccgaatcagcatggtataacgtttcagttacatacaatgaataagttctggagatctaatgcacagcatagggactatagtcagtaatactgtattgtatacttgaaatttgctgagagtaaattgtaagttttcttaccacagacacaaaataactatgtgaagagatggatatgttaattagcttaactgtagtaatcagttcactgcgtatatgcacatcaaaacatcccattatacatcttaaatataggcaatttttataacatttaaataagagcaaaaacaaaaacaaaaacagcatggtactggcacaaaaacagacacataaaccaatggaacaaagtagagaacccagaaataaagccacacacctgcagccatatgattttcaacaaagttgacaaaaataagcaatgggaaaggactccctgttcaataaatggactggctagccatatgtggaagaatgaaactggatccctaattttcgacatgtataaaaattaacccaagatgattaaagatttaaatgtaagacctcaaactagaagaattgtagaagaaaacctaagaaacatcattctggacattggggttaggaaagcatttatgactaaatcctcaaaagcaattggagcaaaaccaaaaaattgacaagcgagacctaattaaactaaaaagcttctgcacagcaaaagaaactatcaacagagtaacagacaacctacggaacaggagaaaatcattacaaactacatatcacacaaaggttcaatatctagaatttacaaggaacttaaaaaactgaacaagcaaaatacaacgccatcaaaaaacaggcaaagggcatgaacagacacctctcaaaagaagacatacaagtagcctacaagcatatgaaaaaatgctgaataacattaattgtcagagaaatgcaaatcaaaaccacaatgagataccatcgcacaccagtcagaaaggccattattaaaaactcaaaaaacaacaaatgctggtgaagccgcagagaaaagggaatgcttatacactgttggtgggaatgtaaattagttcagccactgtggaaggcagtttggagatttcccaaagaatttaagacagaactaccattcaatccagcaatcccattactgaatatatatccaaaataaataaaattgttttaacataaagacacatgcattcacgtgttcatcacagcactattcacaatagcaaagacatggaattaacctagatacacatcattggtggactggataaagaaaatctaaatataccccatggaatactatgcagccataaaacagaatgaaatcatgtccttcgtagcaacacagatgcagctgtgatggaggccattatcctaggcgaattcatgcagcaacggaacgccaaataccacatgttctcacttgtaagtgggagctatatattgggtactcatggacataaaggtgaaaacgatagacactagggattactagaaggggaaggagggagggggataagggttgaaaaactgactattgggtactatactcagtacctgggtgacaggatcattcgtaccccaaacccctggaattcacttgcatgctccctcccataaggagttgaaaactggtctaggtaaatgaggcaaccctgtcacgagtcccgggaaggggtcagggaaataggctgcttcgatatcatacaactctctttttaaaaggtccttccaatatttcttccaacttgaagtccagctttacaacaagtttctggactctcttctttcctactctgcaggttatcagaaaataaaacaaacaaaaccgcaaactacaaaataacaaaaacacccaagcaatgtgattagttaagacattattaaagtgtgggtgtttccagagacgtttcccctttacaaaccatcctattctcttaccttttgagaagggagtgtgtgcgtgtctacgtgtacataagagagacagagaaagtgaaagagagggagatttggtagataaagactcaatagacttaggaatttcctatgtcgttatttgaatttgagagattactgagtgtaagaaaagataatccattttggctggagcagtggctcatgcctgtaatcccagcaatttgggaggccgaggcgggtggatcacctgaggtcaggagtttgagaccagcctggccaacatggtgaaaccccatctctactaaaaatacaaaaattagccaggtgtggcggtgtgtgcctataatcccagctagttgggaggctgaggcagaagaatcgcttcaatccaggaggcagaggctgcagtgagccgagatggcaccactgcactccagcctgggtgacagagtgagactctgtctcaaaaaacaaaaaaagaaaaaaaaagagaatccattttaacttgaatcttgaaattttctgtaaagtagcagaggtaaattgccatggaaatcataggaaaggaaatataagcccaacacggtaatagactctgcaatgaaatatatttatggtgctataataatagtgtacatactgtttatatgttttcaatttttagaataaatctttgacaaaacacgagacctaatcatagttagagaacacagaaggaatgcaactcaacataaaattaaaagtagactttacagaatttgggagaagaaattcagtaggagaagtgaagaaacatggaggaccactaaaatccccattttatcatgtgaagggttaagacatacttttgacactgttttgaagaaaaaaattaacatttaaggtcttcatgtaaaagaaaaattagttaatagaacaaatacatggggtagatataaatgagataatttttcatctctcataagagagactgtagaccatgaaaaaatgagaaaatcaagaattagagatataaacatgttattacagatttgtcacgcattagaaaaagagaatgactcaaatatctgcctctgaggagtgagaaatgagagaggaatgcagcatatttaaataaaagaacttatgaagtaaaaattacttgaatcatgtacagataatttgattaaaaattgaaaacattgattcaaacaaatttatattcattaataagcattgtacactttttaaaattccaataagaaaaaatgagagacttaaaattaggtaggaatgcatttcccagaggttaaaaatttatattttaatatatatgcatatataagcgggatcataatacagcattatatgtatacatactgtgtattacagtctgctttattttttcatgtatgtatttggattacctttaatatcaatgcaatcacctgtaaaattttattttaaatttcccttctttagagatatatcattttttagtagcctcctactgatgaatactggtgttgtttccatttttcactgtaataacaattaaacaataaatataggtacaactcagtctttgcacatagatgtaagcatttcttcgataatttccctggaaatgcaattgcttagtcaagtgtaagcacgctttctcttgattggtattgcaaactgctctcatgaaataaattgattcagtcttctgtcagaagcatacaaagtatacaaggaaaagttatttttattttcattatttggttacaaatgagatcgaacattttttcatatacctttggatgtgttttattttctttttgtccaaatatatggggtacatgtgtaattttgttacatgcatagattgtgtagtggtcaagttagggcttttagagcgtccctcacccaaatatatcatacacattaatttctcattatccactccactccaaccccctcaccctactaagtttccattgtctatcattccactctctgtgtacatgtgtacacattttttagcacacaattatgggtgaacatgcaatatttgactttctgtgtctggttcatttcacttaaaataatgacctccaggtctaacactttcttcctgtatgcttaaaattaggcaatgcatttatttttctgaattgatttgtaagattcaatttcagtttactggtttttaatgtacagattttaaaaattatctatgtgttttccattttaaattttgggtttttaaaatcatttctacatagttctctaccatcgcctcattgtagaaatattcacctatcgttcttcctgttctttgggcttcttaagcttaattatgattgaatatttgttcaaggtgaaatttaattcactgcattgtgtaaagcagggttttgccttttaacatgattatcaaaaccatttctttcatagtccatctctatccactgatttgaaattccatttttattatatacacttgagcatattttgggattttctcttttgtttcactaatctgtttgtatagacttttagtagattttttttttttttttatacagagtcttgctctgttgcccaggctggagtgcagtggcgaaatctcagctcactgcaacctctgcctccctggatcaagcgattctcctgccgcagcctcccgagtagctgggattacaggcgcctgccatcatgcccggctaatttttgtatttttaagtagaggctgggtttcacgatgttggttaggctggtctcgaactcctgacctcaggtgatccacccgcctcggcctcgcaaagtgctgggattacaggcgtgagacaccgcacccagccagtagaagttttattaaacactctaatagctacatgggcaaatgacctttcatttaaggttttcaacattttctattaatcctcatctatattgctgccagataaactttagagtaattcttgtcacatccaatgtcttcctgccaccccaatttaaattttatgtgtttctatcagattttagcttaatttgtagtaaattatatgtctaaaatattaatattcccaccaagaaatataaaattatatctgtccatggatgcaaatattctgttatttttccagtaaaggcttgtatatcaccaaatttcatgctaaataaattcacagtaatttcacattttgaacttctgtggaaaatgatagctttgattttcaataggttgttaaaagagaaattagcatttagaaaaattacatttaattaatatttaattatttctaggttttttcttttcttaatgagctttgggactaatttttcccattagttataatagttgtcattgttgatttacttagtaccaagttgacaatatcatctattaatatgaataatttgacttttttccccaatacttatacttcctgtttcttttacttggcttctttcactgactagaatatgcaaaatagcatttaaaaagagcagttttggtagtcattctagttatatttctaattttaatgaggataccttcaatatttcaacattgatcacagagttggctcttgttttgagatagacaatatttttcatgcttataaactatcatctattcttacattgctaaaagttttgtttctactcctaaattagggacagattcttttcatttatcaatactttttcataactaaaaagtattgtatattttttccttctgatctttacctacaatgaaggatgtaaatagattctcttatagtaggcatatatgttttcctgaaataaatccaatttggcatgataacttcttctcttattggctaaatctgctatgttttataagatttgaacgtctgtattcctgagattggttgatagttttcaatgtgtatgctatttttttgaagtctcataatcaagattataagggctttagaacatgaacatagaggtttaaatactattttcatggtttggaattttgtaaacagataattcatacttagttgtttgaaagcatttctcaatatagtatttttgaagttatttcttgtactgctttttaaaggtttcttacagaatcaaatgtttagttctcttattttccctttaatctcaaatataaaaaaattaaggctattaattttctttgattacagctttgttcttattccagaagttttcatgtgtattttccttattcattaatttttaaatggcctactttttttttggttcaaggaaagaacactactttttctctcctgttacaaaaacaatgtatgtttaccataaaaagatacaacaataactattaagaaaagtacagataactcattttttcattaagcagcaccactgctaacatcctgttgtctactctgagtgtttttctgtatatctgtctataaaaatctaacgtaaattcaatgtccgattcctgtattatctaaaaattatatcatatgatctactaatcatcttttcctatttgttttaaattgcttgctggttttgttacattacatttttttctagacattttataacaaaacagatatatcaaattaatcatattcaatgatgtgttgttgcaaacatatgtttatgaagtccctgcttcgttgacattttttttcttgttcatatggctggattttctttgaatttacgggcttttgtatgggagctgctatattgtttacaagttcaatggcttgcaacctttcctgtgcattatagtcacctggggagcttttaaacagcccagtgactaggttgccacctaaaccaattaaattagaaacttcccaggtgggacctaggcatctgtaagttttaaagactctcgtgatgttctaaatatcagcaaaggcagaggaccattgagcttgttagaatatttgggaaagggtgtttctaagattaaaacttaaggcttatgtatttcgtaaacgcagctgctttaacaaattagtaaacaagctaatcctagtatctctaaaaaacactagtttaattttgcctggagctgcagttctcaatatattgtccagcatatcctccatgcagggaaaccactgtatacaccaatacttatgagggaggatgatttttcaactgcaaatctttaattgccttttagaaaatccatccagttttccttaagcaagttttagaaagcacatacacgagcaattacaaatctggccttcagcctaactcaagaattaaaaaaataaaatctcaaagtgaagttgtattaattctttttttctccttacttttatttcataaaaatagacatctttatcataaaactggcttcttgacatcatttggggccactttccctctgaaagacaattctaattgcatttacttgttctcagaatcatacatttttttaaaaatgaaaatagtttgtacacgagttgccaaagaatggtctaattcagtgtcaggacaaagatggtctaattttgcattatttagtcatctaattaaaaacaaaactagtaataatttagccataaagctgttcattgaagaataaaagcaattgttaattaacttttcattgaggaaagtcatacatttttcatgttatcataacatttcaaaatgccctgggaaattacaaaattaaggtaatgtaaattattgatatattataactctaacaatgaaacattttacccaggcctctaatgaggattctcagttaaggggaggagcagaggaatgcataaacacatgggaggtggggtggagcggaaacccagcttccaggaagatgttttaggagaaaacagattcctaagctatttgaggtacaacagaccgaaggcaatgtgcagtgcaatttatttccctaaacttatctgttataaaactgaatccttaagctggttgtacaaagtcacacaactagtcagttaatgttctacaaatagctctttcagagatttttctactagacttgtcaccttatttaaaccttgaaaccccactcaaaattgacagtgagagaaacagacacacacacacacacacacacacacacacacacaccagggacggagggagagaaagtgtattaatagctaaaacccctcttggccttgggaaagaaactctctaccctctgttaataagaagtgagagagctgcctcctctttgaataaatcaggttctttagacaatgtagagttaagggctttactcatcaccctgttctctggatgccatgtaagctcaccagattcttgtgaaactacagagaatggattagacagtccaaaacataacagattgtacttgtgtttgctctggtaagtggagctttagtttgatgtagagaaataagaggaaccggcatttctttcacctggacattatgaaagagaggtatctgaatcatccaattaagtgagcaggaaatctggaatattgtaggtgttttacatgctcattctttctttctacctgcttaattgtatctgtgctatttctgttaaatgcatctgcggtgaactttgcagttgctaaggagagcgtttgccaattccatatgcctagtctaaggtaggctgaagctaatctgtcattctggagaagcaagagaagctaaggttttcataatatttagttgataagggatgagaactttagatacatgttatctcttactttgctatttttccaaaaatgtatttgaaacactgttaagcagagcaataatatttatgcagcattttacatttttaaagtcctttaaatattacatcatgcatcaaaaattatcgataccaagatgtgattgtctcaattttagagacgataaaattaaaaataagaggttctcaaaatgtcattattttataataactgaacaaaagttttacctcaacatttaacatcaaaaacattttcatttttattagatcatgatgttctgtttgctcgtcacataaaatattttaaagagatgtttggggtttaaacagattaagtatttctatagtgccttgaattaacaaataaaagtaaataatactaaaactacacccatctattgtcttgctatgaaacctagaggtaaagtgtatgtgaagtaaaacagtatttttgaagttgtaatgtcttaccattgcttcaattaaatcgttacatacacacacacacacacacacacacacacacacacacacacgcacacataatatattagatgatagatagattagataggtaggtaggtaggtagatagatagatagatagatagatagatagatagatagatagatagatagacagacagacagacagacagacagataggcatttgtgatccccactgaaaaaaactggcaagcttgcctaaaagtgaggagaattattaagaaatagtaaactacccaaggacattctgttcttttccttacacataaatatgaacgatggtgctcccctttggttccaactttctgtgtttcatcccctatcatgccaccattgtgttagtgtttcccatttctcctttacattcaaagtgttgcctgtcccatttaatattttaatctgaagaaatccttgggatgggaaacacaatggtaaagaatgaagaatcgctttttaaaaatactgatgattacaatgtattcttaacaagctttggatgaatttgtattagtcgcccaaacagttctaaaaaaaatcagcataacagcaaatttgacaacaatcaaaaactcatcctttctgaatatgtccctgaaagaaaagctcagcactgtatgcaactccatcatatggagcccagaacatctctttgtggatatgtgactaaaggcaaaataaacatccagtgtaaaggtgcagaggcaaaaaaaaaaaaaaaaatagagtggtctattggaggaaatacagatggactggtattgctagtagaacggtggtgaatgaagctagaactatagccatgaactagatttttagaaaccagtatcctatacttgggggttagatttcattatgtagacagtagttgtggcaacctatgggattaagtagggtccaaaaacaaatatgtagtagtagtagtagtagcagcagcagcagtagtaacagcaatgacaacatctaggatctattgagcacttaaaacaggccaaatactgttttaagctctttacttgtatcagctatttaattctcatagaaataagtatcattttatcatcattttacaggtgagtgatgaagtatcttgctacacattatggaggtagtaagtagcaaagctggaattcaaacagaaaccagtgtgcctttacactgcaccaccctgtatgcttagggagatcactctgttggcacattgcagggggagaaggacattggagactgtattcaccacggccatatattgtgtgatggtatatttcttggaaagcacaattcgggaacaccatagcagagaaggcaaatattatcagccttctttacaggttagaacatagactcagagtgtttaaattaattggccttacccttctgaatcttcatacactgcactttctacccatcagaattacttattcctatttcctaagatcagtcattccagaaaaaatgaactttcttctttttatgaattcagaaggaccggagacaggtaggcaagacgcatgaacacaaaagtgtcttaaaatctcagagatacattcatttgtgcactttcacttattcattcattcagtaatcatttatagagtcttttatgaaccatgtgctataagctaggtcccgggagtaaaaggcgggagtaagctgacaattaagttttcttttgtccattgaattttgtccaattcgcaggtggtacttggttggttgaacctcctaaagttaccttctagctcatgcccccaactatttgccactttacaaaaacgtcacacacaccataaactgagaaaatcatcagtccagggaggctcattccttctgcgatgaagaattcctatattgtcgcaatattcagctgacaagccatggggtaaaactactgtgagcatttcaacttctgattataccccaccattttttctgatggaatacagagagtggccaaaccagcagccttccttcaggccacatttccccagcccagaagttcctaaaatcttgtggaggcgattcagctttatatttgacagttatttatatttctggccctacagactctgtccgagcaaaagcttttctagacatataattttaaggggaaaatatcaatatttgaagaaaacaagtgtgctggaatgtccctctaccttatgattcatttgttattcctagggtgttctgcagcaggttaagtgggctattgaacaaagaaaaccccaggaattctgacatattctattaccttaaactgatcgaaaatcagcttttcttctgttgagatgaattacttgacagtcagtagaaaaattcttcccatgggtttctcctttctgaaacctttcccacccccagtcctcagaaatatactttggtgagtttcctctatcccaaagcattattcatataatccaagaaaaactgaaagagacttgaggactaatttgcaatgatctgaggtacctgaaatattttattcattttatttttatatttctttgaaataaatacacttactatcctaagggtaactctgatattaaaaagactcacatttattacatatataccagagcctatatccccaaatagaattatttatgagaaaccttaacgcaaataaagatactaagccctcggggcctcttgtgcttttatatttgacatctcctctttttaaatattcatgtagaatagccttaagtagaaacttgaagatgtgctagtataaaacattttcctgagccactttattgttgatggggtgttttctcaatctggatctcagtaagtctttcccttaaatgaaaaagggctatttctcaaaccatgtatgaatgccagcatttgttcagcttctttttttgtttgttttttttttttgagactcagtctcactctgtcgcccaggctggagtgcagtggcacaatcgcggttcactgcaacctctgcctcctgggttcaagcgattctcccgcctcagctccccgagtagctgggattacaagcatgtaccactgcacccggctaatttttgtatttttagtacagatgggatttcaccgcgttggtcaggctggtcttgaactcctgacctcatgatccgcccgcctctgcttcccaaagtgctgggattacaggcctgagccactgtgcccagccttgttcagctcctttagcttactttagagcagtcacaggttgccacttttccagcatcagggacaaagttcagatcaattttataacacgtcgattctaaaaatcacagtctcgtgggaggtggaatatctgtcacaactcataacatatttcctactgcttcatgttccatatattagaaacccattcaccactaatttccccaaatttacaagttaagagtttaaattatagttttataagtgaatttatctactttatttttcaggtcatggattctagctctcatatgaagtaaggtcttaatgctttttatttctttaccttatgttaaatttcagattgatgagctttctaataatattgaaagttcacattactaccttagtagagcttccaaattcaaattgaaatttcactgggctgggtgcggtggctcacacctgtaatcacagcattttggaaggccaagacgggcagatcacttgaggtcaggagttcaagaccagcctggccaacatggtgaagccccgtctctactaaaaatacaaaaaatagttgggtggcttggtgcatgcctgtaatcccagctactcgggaggctgaggcaggagaatcacttgaacccaggagatggaggttgtagtgagcagagatcgcgtcactgcactccagcctgggtgacagagcaagactccaccaaaaaaaaaaaaaaaaaagaagaagaaaagaaatttaagcgaagatgtgagtaactgtatcagaccagactcatttttatatgtaaaagatgaaatggcgttttctactcttaataaaggcaaagatgaactaatacataatgcaaaatgagcactggaagagatatacaagatgggtaagagcaaaactatcaatttttgtatttttcattcattcagcaaataattaccaagcaagtcatacatacgtaaaatagtctttatattttttgtcccatctctatgatagtgatgaaagtgaatgattctttaaaaaaatgataaatattaaatatcggctagatacaaaatattatcattggtgtatataaccagaatttaagttgaatcattggcatcaaagattttaaatagttcggaaaattaaaaaatacattgctagtccccacttacaaggagcttgagaagagaaaataaaaataccaacaaatcaatacagaaatattcactatagatcatgaaactcaatgacctgtaataaagtttaagaaaaacaattttatattgccttgatagaatagcccaaatcatcaaagcagatggaattttcaaagacagtatgctatcatgagaaagacatgtgcggaaactaggaagaagcttgtattctgaatgtgttaccaagaggttacaatgaatgtaataaaacatctttttgtggtaagaaatatggaaagacagtagctgttctactgcattaatctccttccaggttaacaggtgcagcagcagttggcttcagaaactcttgttaatgcgttcctcagactgtcccatctgcttcttattgtttgctccatacaaaggcatgttaatatgtctacctacatatcatcattgtttcattttattatttgctaactgaactgtgccaacatgatagaaaagaatcaagcttactataattttaagatactaagacacttactagtaaaaacaatgtttatcgaatttaagacctttgtggactcataacagagaactagttctgtgcaacaggttcctttcacctcaagccattcaatcaacattttaaaaattccaatacgattgctccaaggacctatgagagatactttggattcaaggacctcagagtcgagtggaaactctttctttaaatagaatgtgacccagaagcccaatatgaaacagatgaagagtgagctattcagctaaaggaatgctgatggtggtagtggtggtggtgggcatccactgtcttctcaccctacacatggcccttgaaacactactaaaacccactaaggctccagtgagactattgtaaaattcccatatattctccagttcctagtttgtccaccaaacctatccacagcttttctttgtttttaacttttaagttcaggggtacatgtgcatgtgtgttatataggtaaacttatgtcatggggatttgttgtacagattattttgtcatccagatataagcctactaaccatcagttatttttttttaatcctctccctcctcccaccctccaccctccaacaggtcccaatgtatgttattcccctctaagtgtccatgtgttttcatcatttagctcccacctgcaagtgagaagacacagtatttgattttctgttactgtattagtttgctaaggataatggcctccaactccatccatgttcctgcaaagtacatggtctcattctttcttatggctacgcagtataccatggtgtatatgtaccacatttgctttatccagtctatcattggtgggcatttaggttgattccacgtctttgctattgtgaatagtgctgcaatgaacatacgtgtgcatgtgcctttgtaatagaacgatttatattcctttgggtataaatgcagtaatgatattgctgggttgatggtatttctgtctgtaggtctttgaggaattgccacactgtcttccacaatggttgaactaatgtacagtcccaccaacaatgtatacgtgctcctttttccccacaaccgtgctagcatctactattttttgactttttattaatagccgtcctgactggtgtgagatggtatttcattgtggttttgatttgcatttctctaatgattagtgatgttgagcttttttcatatgcttgttggccgcatgtatgtcttcttttgagaagtgtctgttcatgccctttgcccacttttttagtagggtttttttttctcatagatttgtttaagttccttataaatgctggattttagacctttgtcggatgcatagtttgcaaacattttcttccattctgtagtttgtctgctcactctgttgatagtttcctttgctgtgcagaaactatttagtttaattagatgccatttttcaatttttgcttttgttgcaattgcttttggcatctttgtcatgaaacctttgtctgttcctatgtcctaaatggtattgcccgggttgtcttccagggtttttatagtttgaggttttatatttaagtctttaatctatcttgagttaatctttgtacatggtgtaaggaaggggtccagtttctatcttctgcatgtggctagccagttatcccagcaccacttattgaataggtagtcctttccccattgcttgtttttgtcagctttgttgaagatcagatggttgctaggtgtgcagtcttatttcttggttctctgttttgttccattgatccatgtgtctgttcttgtaccagtatcatgctgttttggccactgtagccctgtagtatagtttgaagtcaggtaatgtgatgcatccagcttttctctttttgcttagtattgccttggctacttgggctcttttttttggttccatgtgaactttgaaatagtttcttctagttctctgaagaatctcaatggtagtttaataggaatagcattgactctaataaattgcttaggattgccttggctacttgggctcttttattggttccatatgaactttaaaatagtttcttctagttctctgaagaatctcaatggtagtttaataggaatagcattgaatctaataaattgcgttgagcagtgtggccattttaatgatattgattcttcctatccatgaacatggaatgtttttccatttgtttctgtcatctctgatttctttgaggagtgtttggtagttctccacgtagagatctttcacccctctagttagctgtattcctaggtattttattctttctatggcagttgtgaatgtgattgcattactgatttctccctgttgcactgcatgcaacagatgcaatggaacagatttctctctgttgttggtgtataggaatgctagtgattttggcacattggttttgtatcctgagactttgctgaagttgtttatcagcacaagaagcttttgggctgagaccatggggttttctagatatagcatcatgttgtctgcaaacagagatagtttgacttcctctcttcctagttggaggcgctttatttctttctcttgcctgatttccctggtcaggacttctaatactatgttaaataggaatggtaagagagggcatccttgtcttgtgctggttttccatgggaacacagcattccttaaatagacatgaagcccctgcccacaccccagtgaaaaacaactcactacttccagattaagctttttatatttttggccatctctcactgttacaaagtttgtttgtttaaatatttagtggacaaagggctctctttcctttcttctcatcataataagaatatgcttcattgcatttccactgattagctgaatatttgaaaacagctaatacgtccctaaaattataagttgctttctagacaggctccagtttttcagtgtctcatttaaattatgttccccagagctgaacagtacagatttggtctgatgaacttacttttagtgtcaacaaagagggtgttctgggcaccatttcaattactatacttatttgtttttcttgtatctctatcataatgttaaagtcatcgtaaactcttgtttttttatttaatacttttgggtggagagaggggaatgctaacttaagaaattatattttccctattcaattttattttgatgtattaagcaactatttcagtgcctaatatgtgccaggcatgtgataaacagcaggatgcaaagtatacatagtctacatctacatggtgtatacatatagtcaaagaaatattataacagttaacatgtattggtaacttaagacatatgtatagaggaatctgaggcttggtttgtggtcaagatggtatatatataatccttggtttgtttgcttcttgagacaaatctagaaacaactaggccaaagtaaacactatcaactattataatagtcatgactcctttgagtatttattctttcttctggaactctgacagatattgtgatttaagggcgtagggataggaaaggaaaaaaatgaaagcaaagagacagtgagaacactttttagagccagggcacagcctaagatgaagaacaaatgaaagatctacatcagcagccaaaggtaaaaataagcacttcagaaagaaaactgattttccacagaagaaaaaatatggcagacataatgtctgatggcataggctccagatggaataagaaatacacagctgcagagtaaggctatcttcagttaatcgagagaagcctgatcatcagaagcattagccaatgtctgtaaacatataataataaaataaatgcagaaatcactataaatctttgtgttaattttgttttataaaaataattcaagaactgttattttggaaccattatatgtatatagtaaggtaattaccatataagcaattatactaatgtcattagaaacatagattttcagcgtaagagagaagagactgcagttaaaatcaaatatgttcgttcctaattcttgatccaagtggtgatctgagtggtagctatctgtgtttatggtatatggttatgttatgcttcaataacaaagtgtattaaaaatagaagaaaatgcaataaaagttttaaaaagcaaagggcaagaataaagataaatcgtttcttcaataaacagtgcttatcaatcactattgcacattttatttcacttaatttctcagaaaaaccttatttctattgaaaatctctgtatcttcaggcactggaaagactcccaccaatttaactgtaactcggatgttgatttcctaacacaagttcctcccattatttaatttacctaaggactatcagttaccttaatggaaaacccttccacttattatatctctaagttatctaacaatcatgtctcttaagaaaatatatatttttatctcaagtaatctcaagttaagattactacctttaactaaaatgtttatccattcaattaaaatttattaaagtcagctttgcaaatggtatttcttatttttcttcttcctttcatatgtgtacaaaatattaattcaacccagaagtgtttttcctccctaccagaaaggtaatcttattggttaatttattacctcattcacttaacttctacatgttacccagataaactattgtaaccagaacttacattattacgattgcaatatacattattaccaacctgctatttaggagaaaaaacacttcttagatatcataaatgcagctttaacatgcagaactgctttaaaacaggcatacaggaattttttggggggggatgaggggtgtgttatttttaatatgtctaaaggtaatacatttaatgaactatacaatatttataataagttattacaaatatgttcattttatgaatttttattttttcttaattatgaagtttgtaagtatattaggaaggtaataacttcacagcaatgtggcagacacagttgaatgtaacgtactcattaattttcaaaacaatcctatgagatatatactcttaagattccttttgtaaatgaatagactgaggcacaaagaaggtaaataatttgcctgagagcattcagtgcgcaaagtacaaggcacctaatttgaatttggcttcagaatccaactcttaatagctacattctgatgaccctagatccagggactcttctcatccaattccggttttgttgtgttttatgtaaaacacaccactgtgggttatcagattccaattttgttcattgtcttgaggattttatcatttacctgtaaactaaactgaattctgccatctcacccattttgccactcttactaaatactcaattgtttagttttccttcaatatcgggctacatctctccaaattgatgtttataattttttgccttccctcttgacttgacatcactgagaattaaaatctgactgcccaaatccttactgggactcctacaacctactgattctactgggacaacctacaaggttgtcttgtagctgtctttctcccccaggatttgaaaaagccttgcacactgaagcccaagaacttgatataaacttcaaaagacttaccaccacaacaaatcacgtataggcaaccttcatgcctggagctcctgctacaagagccattcagaaagtccactggaactccagcatcatccgtgttctgttccaggaaataactatgactgtgaaattaatgtttatgccatcaccacattcaaaccataaaccagaaaatccatcagattaccactctaccatctgaagatgcttagaattcaatgtctagaaaacttcttaactgcctgccctctagactcaacaaataggatttatattcttctccaacaagtttttgtttttatgtttgtttccatagaggtgcctctcattaaatgcctgatcacgtgcatcatccagcaactatgctctactagcaagtctcaaccgatgatttagctagtccttagtaaacaaaaggcaatcgaatgacaaatggacttacactgttcagaaggatgaataatgtgtcttctttacttgaacaggagtgaggctccaccaagacgctccccttgaccaaactttagctaggctcctctgagccctcttctcagctaggccataaccttggcctgcacagacctgaacaaaaaacactaacatagcttctaacaggtcaaagccacctctctaggataactctagccccacttaaggtgcatttctgagaaaactcaaagctgccaaaataatttaccctttgttccagtcaaaacccgaagacagtgagaaggcaggagcctaaccttaagtgccatttagcaaacgtagaggtttcccagggaacaatcccacctttccactttttgtaatttgttacttccctgactttaatgagccaccactcaaactcattctctcattctccctttaaaactcccagtcacctctacacaaatcaaagttcagttcagttcatgctgaactcttctctattataatagtgtattactgattaaaatctccccttactaattaaactgacgtccacttttgcttatctttggataactggttatttagttggtttagtttcagtttgtgaatgtcatgtggtctcaaaaggtcacatcatatagataaaaccgtgcacgccaacatcaatgaacatgtgaagaaggtaaacatgattattttattgcaccatttgtaaaaaaaaaaaaaaaaaaaaaaggtcaatttaaacgaagtactgcatgattacattgaacgtatttacgtatttgttgaatagtatttttcccttgtaaaattgtatatgttaattatacaaatgttggaatctacagaccatggaagcataaaatatatattgcctcccattctgagaaaatcctattgaaagataagttatgtcatcacagtttttctgtttttgtttcgttttggtatggcttggtttctggcttttgttgttattattttgtctatataggcaagtattcatttatttcctgcattagtcaagggtctctaaggaaatatttgattttatcaacagctgaagtaggaaagagtgcctggaatataatatccacttagaagttttttatggtatggttgattcacccattctatttaacctcagcattcaattactctcactgctatttttttttaaacctgaatcatacattttacatttaatatacactcattgcaaatacatttaaaaattctaataaggcagagcctttagaagaatgcttgactcagaaactcaataaatctttgttaactattgaaggaaattttaattaaataattaatattcataatcccactcaacaaaattactgatttttattaatagttttttcaatcacctgtatattttaattagcatactgtaaagaaagtaatcatttttcctttttaaaataaaaaacactatgttatactgactttatcactgagataatctcaagcagttattatgagctgcttttgagctatttgaaggtacagttttactgctatgtaatttccaggcctatgtacatctaggcataagattttctcagctgttaaagctcgtctcgttgccatttgtcccctcttaatgatagcaagaactaagtcatcccagttttgcacatattatacttgcgttaagttctttttccagttataagaacacaactttaatttcttatggataatttcatctgaacaacacattttagaccgaaacttcagtttccttaataatttgtacttttgattgtgggaaaatgacaacagcatacaataatagaatattatacttttctagctggggaaggctgatgacacaaaagcataggactacaaaatggcaaaaaacatgattatagtgtatacatgagtttttttgcaaagatctgaatagagaaaagcagtaaaatagtcttcacaacatatattgaaaaatgctaaaaatacaataacttgcaccattgcagctagtactatattcacattataaaaggccatttaatgtatccaagacaacattggcagacacattaaggttatgcttttgagttctattgcttttctgtacttctgttttatttgatttgaaaatatgatttgttgttgtagatctatatgccctttcaccataaagagtgtgccctttgttttatattcgtgcttctataggtaaattttaataaaaataattttaatcagcattggttgagcatagggctttttatttctttaaactggcctgtttattactcaggtttgagtagcactacactataccaagcatgaagcaaaatgtcttaacactaggggaagctgagcttggttctttgtagaaaaactctatccaggagacatggggtagattaatacagacattcacacacacctccacacatatgggaaggttgaagaatttgtaacatcatcgttttattaaaacaaaatatgtctcaccacattgttgggtacatgttactgatctggcttaataatatataggatttaacttcctgtacttgatatgcttggaggcaatattactgcagtacaagccagggcatcagtttcactatgcttttgtcagcatagaaagtagcactagaggacaaaatgaatttgaaccaatgaagctttcatacaataccctgaagggtactagtgtaagacaggggcaagaaagaaacagtgatgatgtgagatgtgacccgataactgtccttcatggatctacacaacctctggaaatgccttctgcctgcaagaagcgtcaggagccctagaacatatgctaatatatataattaaggaggccaaagacaatcataccactctattcaacgaaatttatatattcacatacatacacacatatacacgcatgccacatatacagaaatttatgcatacatgtgtattgtagtttgagtttcataataaaactcaaaagtgaagacagttcacatgcacacgaattattagacacaaaaattggaaggaggtaaaggataataaagtgttataataacaggctgaaagaactatgattctgtcttctttatcccaaaatgaacttaataaattaatataacctcaattgcaagaggaagaacacgttgaggttgcatactaaggtgtattttatatctgatggttccatagctatgaaagtcttgatgatgccaatgctaggcatccaaatttgcagaagcaaaatctctggtcagattgaaaatgtgttacagtaaggaggaggtctaatctctcatcttttttctctgcataaattttgagtgtgctaaccacacaataagtaagttgtcaataactactgttttgattgattgtattaatccaaatattgaaatgagcatgtttgctgctttactgcttccttgttaacgcctagtaaatgttaattactaagtaaagtttctgaatgaataaataatccagagataaatgttatacccacacctcaggaatgcccactggtgatctacaagagaagttggggtcaaccaaagtgtataaaggtcatacagaaaggactcaggaggtcaatgtaaaggaggcttccatcgcataaagatgaaaaatatgaggacaataaagatcataatacagaaggtggagagcctcagttacatttaaatatatttaaattcatgcattcgcagtgatgccaaaacaaacaactggatgataataaataaataaaatattcactggtggtcgggtgcggtggctcacgcctgtaatcccagcactttgggaggctgaggtgggcagatcacgaggtcaagagatcgagaccgtcctggccaacatcatggtgaaaccccgtctctactaaaaatacaaaaattagctgggcgtggtggtgcgcgtctgtagtcccagctattcgggaggatgaggcaggagaatcccttgaacctgagaggtggaggttgcaagtgagccaagatcacgctgctgcactccagcctggtgacagagcaagactccatctcaaaaaaaaaaaaaaaaaaaattcactggcaacttttggaagagactagagaagcaattcattattttgaaaattgttcttttgggggaaaaactgaagcatttactctgctttgctttgtatcaattatactatgaggcaaccaaatagaaatgcagagttctctttataagccgggctcagtgactcacacctgtaatcccagcactttggaaagcaaaggtgggtggatcacctgaggtcaggagtttgagaccagcctggccaacatggcagaatcccatctctactaaaaatacaaaaattagccgggcgtggtggcgtgcgcctgtaatcccagctactagggaggctgaggcaggagaattgcttgaacctgggaggcagaggttgcagtgagccgagattatgccactgcactccagcctgggtgacagagcaagactctgtctcaaaaacaaaaaatcaaaacaaaacaaaaagttctctttatagaactgctcctcctaacaaatgaagaagtaaaaacagtatatcattgttttgcaactcataatgaaataatcaatcaaaacaatgatcatcaatggctgccaatatcaaacgttatataccttttgttgaaagtacacaacactttctatacaatcatcttgagtaaaaaaagaacaaaatcaaactgactacaagtagctctctagacttagctgctaatttgtcagcaccacaggagctggtgaaacacattaaacaatatcatgtggatgtaatcaacaaacctagacaaaaggtcctgtttcttcaaaaatgaaaagggagagtgagaacgaggatgagggaggaggaggatgtagggtgtggaggaaacagagacaacagagagaagagaggagtcctataggataatttgggaaatataaaatgtatttgatgatattaagcaaatattttccggggctgggtgcggtggctcacgcctgtaatctcagcactttgaggggccaaggtgggcggatcatttgaggtcaggagttcaagaccagcctgaccaacatggtgaaatcccatctgtactaaaaatacaaaaaaattatccgggtgtggtggcgcatgcctgtagtagcagctactcgggaggctgaggcaggagaatcatttgaacctgggaggcggaggttgcagtgagccaagatcgtgccactgcactccagcctgggtgacagagcgagactctgtctcaaaaaaaaaaaaaaaagaagtggggtgggggggttacttgggaatacagtctgaaatgtttagagtagaagtgatatactttcggggatttgcctcaaaacagagaataggaagtgggtaggtagagaggaaaccagatggtaatgataataatggttagagctaatgagcagtgtatggtatgcattatgttacttttttattttgtatatgtttgaaattcttcataagagaaaaaataaatggtccatgtgcacctgtaacataataatgacaagatatgtcagcctaagaataaatatgtcttaagttatcccctttacctcatcttggcttcaaagtaactatatgctttaatcattatagtttgtctaggtccccagagagtgtttttagatttttatttgttagtttatgaacttcagtcaagtaatcagaaagccaatataataaaatagtctttaactttctggaaaacatgcaagcataaataaccatcatttatacttctgtagcaacagtgacattgaatcatactcaaagcaaagtatctaagattcagagtaagtaggattctcacttgtccaatgcaaagattcagctacatctggtgggtaaaggagttaaatattaacttcatcttttagtatctatttagatctaatttgtatagggggttaaggatctcctgataaaaataaaattaataacttaaaactctccataattagacaacatattagctttcatgcccatcaaatatgaggagctgcaaaaagcacagtgtcaaggggtaagtctagtgttctcacgtaaaaatcatcttgcagatacagacaggataaactaaataataatgaggcctaagatttggagtggaggaggagtcccaagtacaccttgatggctgttacctgcacttacaaccaaaacagccattttcatgtcaaatgtgtgccctgggatacaagatctatgtatacattttaaagaattattttattacaagtcactctttggggtccagcaactctactatgcctcctttataacagagaacagattaaaacactgagaatgggaagtttccccttgctgcttcatggatgtaagttgagtagctgcgacttcatgcagactgaaagaaccaagcaaagcaccaaacagtggcattgaagaggttgactgacagtggtctagggcacagtttgagctgcagcacccgtggagggaaacctctgtctagattatcattagcgtagctgatagaggtgagaaaggttctgggagaagcatccaatcacagagctaagtcaagcatcagtccaaatttcagaatgtctgagtgataaacatcctgcagggacaatgatgcaaattggagtagaaaacactgaagagtggccaaggtcttgcaaatgcacatggagatgctaacaagctagcaaaatcctggtataaagccaacactacccatgattacacaggttcataatgccacaggcagtttaggttacaataaaattcatgaattcttcagtgcttggctgggcaggatatgtactgaacaaagcactcccgtaggtactgaaaggcagtgcctattcactaactggtgatgttattcatccgtttcctgaaccaggaacataggagcccctttgtctcctctttcatccctcccagccagtccattgctcaatgtctaaaattggattccccaagatcagacttaaatgacaaatttgagtccatgtagctgattatgatggagatcacagaaagcatcaacaggaagtgagaaacaggaagatctgtgatggagatcacagaaagcatcaacaggaagtagagaagtgagatagagaagaaaggaacacacagagtacattaatgagcaagttatgactatggatgactgggacttaatgccactggagacttctagcaaatgaaatagacatgcctcatgcatcctatttgagtgtaaaaagtttagagtttttatcatccaattctcatctattattaacctgaagaatgctgcttgggtcttcaatattccagcacttctagccttccccgcagtggcaaacccatcagagaaagtcttcaggtgcacgcaattagatgatgagacaaaatgggagcgctgaaagggtacggacagcgtccactagatttaaagagtaccctacatttatcttatagtgtagactatagctgttcttgcttttttgtaccaaatgactcatctttttttccttcctttagaaacaagattgaaaatgtaatctcggttgaacaggaagcatggagatagttcaactgaattggaagttgctggttgtagaatatttctatgcattcttcaagacagtgccatgtgaagcctcttctgacctgtccagttagcttttatttctctctcttttgtgacagcactgtactttgcacatcttattgtttcattcttcacacttttcagtattatacttatctatcttccagtaaattcttcttaacagactatcattttcttgagagcaagaattgggtcttcgttcatctttgtattttaggcatggagtatagtccccaagaaccagtaagtgttcatcaaatgttcatctgttgaatgaataaatgactgtgtgcattgctgctaatgatattcttcaccattttcttcagaatctgcttatgctggtcagattaaatggctttacttgagctgtttccaactttcaaacagattttttttttttttctgacagtgatttaacaccactgaaagttttcagttaccttccagttgttttaaaacatgaaatagctatttctggtgaaaggaaataaaggagaagagatagttctcacttcaatttgagttttgagaggatcgaattgcttcagcccaaggggtcaatactgacaggtcatccctagcagctggagagtatgtcaagataatactccaaaagatatttttatccttcatttgctacaaagataaataaatgcatatatacaaagtgaacaaaagctttgaaaatagtaaaatgttaacataggatagtatagtcactgttattgaatgaatgtttgtgtccacccaaaattcatatgttgaaatcctaactcccaaagtgatagtattaggagatgggtttggggctttttgggaggtgattaggtcacgaggatggagctctcattattggaattagttgcctcgtaaaagagaacctacaggccaggcgcggtggctcacacctgtaatcccagcactttgggaggccagggtgggtggatcacgaggtcaggagttcaagaccagcctggccaaaatggtgaaaccccacctctactaaaaatacaaaaaattagccaggcgtggtggtgggtgcctataatcccagctacttgggaggctgaggcagagaattgcttgaaacccggaggcagaggttgcagtgagccaagatcgtgccactgccctccagcctgggagacagaatgagattctgtctcaaaaaaaaaaaaaaaaaaaaaaaaaaaaagaacctagaacgctccctttcccctccaccatgtgaggaatcatcaacaagatgaacgtcactgaggaagcgggctcacaagacacctaacatgctggtgacttttggactcaccagcctctagaactaggagcaacacatttctgctctttataaaccacccagaaatataatatctatatgtatatagccaccacccatatatgtacacacacacagtttatcaatttttgaagtgaaataacatataaattaacaaaaattctctcacgtgctaccacatacatagataaaatatgtatgtattttatacatacatatatgcatgtatacatacatatacataaaacatgtatgtaccacatacatagataaaatatgctaccacatacatagataaaatacttgcccagatacatagataaaaattcaagtaccatcaaagtctaccttcttcctatctataaagctataaaatgagtggtatgagactaaacagaaatgttctgtgctttttggcacaaacgcatatttgtttatttattatgtatgtatttatagtgttttcatacaaatagaacaatttgacatatatataataaactagaacacatatgcacatatgtatgtacatgtatgtatgcatacatatgcacatatatatgttctacttttgtgcaattaatactacataacgatcacatttcaacatctgtttatataaattcatctcttgtttaaaactgtagtataaagggcacaggcatggactaccaccaagctatgtccatttagattacctattttactattacctagctacaaagaaaacccatgtccatctaaacccttactcatgtgaaaacataaatgaagggcaaactccttgaagtagaattgctatgtaaatatgtaattatacttttaattttgaaagataatgccaaattaatctcaagagtctgggcttgtgttactccatagtcaatgatggcgatggtcctcaactcttgcctccaaaatgcattcattcttgaataactttgatcagatgagacacttatgatctcaatgctcattctcctactactctttggataaccttgtttgacatttttttttacagtgtgtaaagcaaagagaaactccaaactctttacaaatatgctttgctaaagaataagacctatttgatagcacaacagggtaagtatagtcaataataacttaattgtaaatttaaaaataactaaaagagtgtaattggattgcttgtaacatgaaggataaatgcttgaggggtgtatatcccattctccatgatgtgattatttcacattgcatgtctgtatcaaaacatctcatgtaccccataaatatatatatctattgtgtacccacaaaaataagatactaaaaatacaaaaattagctggacatggtggcgcacacctgtaatcctagctccccaggaggctgaggcaggagaatcgcttgaacccgggaggcggaggttgcagtgagccaagatggcgccactgcactccagcctgggtgacagagcgagactccatctcaaataatactgataatgataatgataatgataataaaaataataacgaaattcagtggattctgaataaggcacaataagaagaattttctttttctttatttagtcttaacactgaaaagtcttaatgaatgtgtatctaccatgtgaaattagacagaatttaacagtttaaaatattaatggaaatatttttcatttaatctatttgttctaaacaattgctaaaatattttggttacatctaacctcacaaaggcaaccattttctattacttttctatattcacttttttcctattatttactgggtttcttctgttattgttgttgttttttcctttttgagacagaggttcactcttgttgcccaggctggagtgcagtggcgcaatttcggctcatggcaacctctgcctcccgggttcaagtgattctcctgcctcagcctcctgagtagctgggattacagatgcctgccaccaggtcaggctaatttttgtatttttagtagagatggggtttcaccatgttggccaggctggtcttgaactcttgacttccagtcatccgcttgccttggcctcccaaagtgctgggattacaagcgtgagccaccgcactcagccagtttgttaggtttttattaggtgcaagattgtgctgtattttttaatcaataaaaacacaagcaagccacagctccaagaagtgtacaacaaatgatttgactggagaataatttttttaactaaatacttggtcacactatataagtggcatgtgaagaaaaaacagtcactttgggccgaaaatttcagggaaaaaaacccttatggagtaaaaataactttatagtttattgctgaatgatttacatttttattgatacagctaacttgtatatactcagtgttagttcttaatcatatttaatgcctgttacacatgccacattcctcatgaaactattcatgattcttctccccataccaataatttgtattattccattctcatataacatgttttcggtatgcttttaaattgacaatatattttaatttctcttataattttctatgttctatgttctatagtattaaaagattcatgacctagagacacacacatatatatatatgtgtgcacacatccatatatatttaactttatagaattcttgaatttgactgaatagaaagtggtggccaagaatattaaatctacctaaaattcacagaggtttgagattcacaaaaggtcacttgatttggcttacaggttcaggggagaaaagtaaatttcatggaagaaaatcataaatatttgcgagtagataaggtagcagatgtagacgttatctatagggaaatctgacagcaaaaggaatgagagctaggatgttacattcaggggcctgaattacagtttgctacagatacaatacatccgcacttagcaaaaattacatttataaccttggcttttaatcaaggtttaccataatgaaaagctgtgaagaacttgtatgactcgcttataatttttttggttttttttaagatagggtcttgctctgtagcccaggctggagtgcgatggtgcaatgatggctcactgcagccttgacctcccgggctcaagagatcctcctacctcagcctcccaagtagctgggaatacaggcatgcaccacgacgctctgttaatttttgtattttttttatagaggtgaggttttgccatgttaccctggcttgcctcaaactcctgagctcaagtgatctgcccaccttggcctcctaaagtgctgggattacaggcatgagccactgtgcccagcctaaaaaaattgttattgatgtcactaaaaactgctcaggaggaaaataagtaggtcttattgtgatgaaacaatattttattgaaaaaaattgatcaacattttttatttaaaaacaaaactggggctattttattcagtaatatgccagtattcacatagcaagagttttgagcataggctttggagcctgagcatctaggttcaaatcctgactttaacatttattagtgggacgatgggtaagttcattagcatctccgtactttagtttctttccatatgttaaatatggataataatggtgtctaattcataggattcttatgagaatttaatgcctgattataagtgaggttaggatggtaccttgacatagtagctgttttatcattgttctggattattatatttattatctatgcctattttatataccatacatgcctgtaaataaagtttgtctaggatgccatggaagaccagagttcaccacctttgtggagatttgataggattttcaccattagataataagagctatataatgtatgtttcctctttagtctgggctcccatgattcttggtgccaaacgttttggtttaaattcagtaactccaattgagccatatttctgtcaaattcttccaaatgtcaactatatgtggcttctagtcaatttgaccttgttttactgattctgatttagtggcaagatggtagatgaatgcaatggtttattctcgtgattttaaatttaatcatttgtaattatatacttttaagacgtaaagcttcacctgtcataaaacatgccctttatggcacaatggttttaaaatatggtcccaaaactcattggcaaatggaaaggtagggtctatgtcctttcctcttcaatctgggtgagtttgtaactacttcaacagatagaggatggcaagagtaatgttttgtgccctccatggcagggtcataaaagaccatatgactactaccttgtttgctagaacagcgtttgcttggaaccctgagttaccatagaaaatgtgtgagtatcgtaaagccaccatgctaggaagaagccaaacaacatagcaagttcacatgtaggccttcagaattccaccctccagccattgagtccaacttagctttcaagtcttgacagatgaggctatagatattgcagagcataaacagaacatccctgctgtgtcctatctgaatttattactcacagcatccacggcataataaagtaattgttttaaactgctaagtatcagggtgattttatacacagcaaaagtaagtgggataccctgccaatatgtctacatatttccaaacaactgaaaacatgcacaccccaaaatgttttcttaatgagaaaatacaactcacttttttatttctgtgccttgattaaaaaaaggcacgtccactaaaagaatgataatttttattctgattatgggataaagaaacatatggccatttgtgacatacaaaaagtctactggaagcaaaaagtgggaaaaaaaagccttacgaatacccgtaaactggtgataaatggacaaacaaaatttggtatatccatacaatgaaattttatttagcaaataaaaggaatgaaagactgatacattctacaatatgaatggaccttaaaaacattatgcaaaatgaaagattacagacactagaggccacatatagtatgattccatttatatgaaatgtccaaaataggcagatctatagagacacaacacagagtagcggttgccagaggctagagggagagaggaatggggagtgactgctaatgggcatacagtttcttttggggatgatgaaagtattctgcaactagatagtgatgatagttgcatagctctgtgaacatactgaaaaaacactgaattgtacacttctagagagtgaattttacagtatgtgaataatatcttaataaagctgctgtaacaaaatccccaggatatcccatttctaaataaacgtatttttcccttgaggtcttctgatgtttacacctctttttgttgtgctgtggctttttggaagcagatttctctgggtttgttcatttttgttttatttcagtattagaaccaaccctgcttatatatcctgtctttttttaaatttaaggcttaacaacaaacaaacagtagcaataatcccaattcccgagtgattcaacaagttttattgtgcagatggtaagaaactgtttccctcattgtttgctaccaggagaaaggctgtgaaatagttcttctgggtcaaaacatatggttcacaaaaatgacttcctttcatcttggtctcttcttgccttctgaaagaccaattcctcctaattttaagtttacttttggcaaaatggtctcatgtattaatgactttatttggttaacaaagtaacatgtttacaggcatgggagaggataaatgaagctagaaaaaggagtactgaaaatattaggttaatgtgttattgttttcaagagccatctataacatccttgaaacttacacaaccactgactaaacattttatttagaataatcaggaaccagtggaaaatctgcttatctagaccttgaagcatcattttttttttctgaaaatttcttcctgattacatccagtggcagatactgctatttgcttgtttgcttgcccaatatccaataaacccagcaaagaaatagttgtcttgatggactattaacagccaacccacagtaaaaacaaattctaaaaatttaaaaagcatagtaaccaaaaaatattcactccacattttgctttttaaactttaaaaaatgctttttttttttttttttttttttgaaaccctgaaaaagtagacagtaagccagctcctggaagaattggaaatcaactgcatgagggtctaggaagctgagaggctgaagcagtctcaggacaagtagatagggaggagtcctttttctctcaacaacaaaatcgtgattttgtttagaagtagcaaggtgtcaagcaagaacaaagagctctatttcaagcatctctggcacccagtcatggccttttggcatctgagaggacgacagctagggatttctgggatagttttgttttcctgatgtacatgctgcctcttccttcttcttgcttcctttttcatctttctgctctgaaatgtaagacttgaggctggagatgttgaaaccatcatcttgcaaccaagagttgacaagcatgagaatgatagtaaggtgtaaaagagcaagaagatcaaaggggcctgggattttcatgccatcacagggccagtttcttgctttagactccattccttcagattccatcatatgagaaagttaaaatcctctggttctagtttctgctacttcgatgcaaaaatgcaatccctggcctggcacggtggctcatgcttgtaatcctagcactttgggaggccgaggtaggtggatcatttgaggtcagaagtttgtgaccagtctggccaacatggtgaaaccccatctctactaaaaatacaaaaattagctgggtgtggtggcgcaagcctgtaatcccagctactcgggaggctgaggcaggagaatcgcttgaagctgggaggcggaggttgcagtgaattgagatcgcgcctctgcactccagctttggtaatagaacgagactcgtctcaaaaaaaaaaaaatacaaccctcacttgcagttcctctcaactgggcacaccaccataccctgggtacatttaagaaacgtgaaagcactgtgattgtccccataacggatggaaaggtgctctaaggacgccagacatccagtaacacgcaggaaagtccaggaaaatgagtaattgtttcatgtcctattcagcttttgaaaagtaggggacagcctgtttataagtatgtgaatatatagaacctagctcaattttacatataaatacaaagtctttatatgcactgcattttccaagaatgaaactatcccacaataaatcaaagggaaaatgtgcacttattttattcagaactttaccaaatgttattaatcatacagaaaaatcccattactttaaaatatgctgttcatggcattttaatcattcataccactcacctgcatacgtcagcatttcgagctgtctacttctgtggttttaggtacaggtactacatttatctagagcagtatgtacctttcttattttcatattgaataattaattattgatgataaatatatccattatttttaattcattattgtcctttgatttattttttacaaggtaattgttttagaattttatatatatatgtaagttacatttttggtaaattctctttgaggatagtaatgggagtattacaaaatatgtcttacaaaagagggtgttcagtcttacagggttaaaacctatacggtacatagaagaaaaaaagtttttaaaagaaacacggtagcctggcgtggtggctcacacctgtaatcccaacacattgggagtccaaggtggggcggatcgcttgaggtcaggagtttgagaccagcctggccaacgtggcaaaaccccatctccactgttacaataaaaatacaaaaattaaccgggcatggtggcacacccctatagtcccagctgctcaggaggttgagacaggagaatcgcttgaacccaggaggcggaggttgcattgagccgagatcatgccactgcactccagcctgagtgacagagcaagactccatctcacaaaaaagaaaaaaagaaataatgtatacatatttagaaaataagataatacacccaattgattaaattatgattttcatctgtaaatgttcctatgccttcagatgtttattttaggactgtggccgacttggttctaaagaagatggatcaccaggtcattacagggctttccttcacaattagaaactaaatataagactcaacccagagtaatttcagaaaaaaaataaaataccaatataaggtgtattgtcaaagataattgtgctcctgcagcttttctgtgtataatagactcttccttccttgtagcagcttgcctagattgtgaaaaacatggtgtttgacccttagaaaggtcaaagacttatataagatatatatgtatatatgagcatatgtatgtgtgatatatatatatatcacactgatatctatatatgtacatatatcagtgtgggaaggaaatggaggaatagaatgttaattggaacaagactagtagtagctgattagttcttcattccactaaacataacgatgggcaaatatctagctgctttaagtcttattttataaattgaatatcaaatactaaagaaaaaatacattttcacagccaggaaaaacatagaatttttttcaaatttcaaaatgccaagtaaaacttgagaggaaataccgagcaaataaggaactttgtcccaaggtatggaaacattgacaaaactattaccagttatagctgacctttactgggtaaaacctggataaacaggaaaaactttaagagaaaagtcttcttcagtgggtcaaatcccatggttttcatgaactgggcggactgctacagggcaggaagagtttactacacagagaaaagttgtgggaacacaattatctttgaagaactcttgggccagtgtaggccccgtggtgccagttccctgtgctaagaggcagccagggatatatacctcaccctttgctatatagctgccttgcttagaaacttcttctaagagaaatgccttatcttttcagatttatattaaatattttccaattctatttctgcctttatctcaggaaattccaagtgagtatgaagctcatgctccctccctaaaatagcaaaatagcaagctctttgcatggatttttaaaaatttatctttttttttgagacagggtctcactctctcacccagattggagtgcagtggtgcaatctcggctcgatgcaacctccgcctcccaggctcaagtgattcccccacctcagcctcctgagtagctgggattacaggcgtgcgccattacactgaactaatttttatatttttagtagagacgggtttcaccatgttggccaggttggtctccaactcctgacctcaaatgatccacctgtctgggcctcccaaagtgctgggattacaggcatgagacactgcgcccggccgtatgatctttttacaaggtttcaagtaacaattttatttcctttgcttcaaaatttccaactattgccattcaagtgctttccactgatagtctgcaaatacacaacccttgaagaactcattgtaactatggccaaaagagtcactgttttaaacacaatctcacataaagaagacttaaactaggtgtactagttgactccatctagaaaattatttctcctagacagaaatcttagattaggcaaatgtgactgagctaaacaaagtctttataatttacaagttcttagggatcaattcttaattttgtacaaaaccacaattaccaacatatgatctccaactctgacaatggggtcttatttttaatctccattataaattggcaacagaaatcttctcatctcatttcagtaaagttggctttgccaaaataaagaaactctctttgaacctgaatcagatgatggatgtacaagtcacttattttctgggcttagagttactctggagagtaaccaatgtttaatttatcaatgttcctagaaattaattagtttaacatgacctactgttgttaccaaagtgtttttcatactaggtaatacaaattgggcctgattatctaggcaattgtatttaattttctgttttggttcatggcaaccaaattggcacttataactttttcccttttgtccaaaattccattggaatgacggaaggtattcatgtgtttagaggaataaaattataatcaacctagaaaacaagaaagcaagcaagcaaaagaccaagatactggtgaaaatactgaaagatgtagatgggatctcactggtaaagaaaacaaagaagagtcaataaaaccacaaacaccaggagtaagaagaagcttcacacctttggttgacaaatagtgtacttcaattctgctggctgttgtaaaggagattacaggatacctggaagatatataatgggagaagtagtctcatatagaagctattgtgggtttgggtcctttagaaatttctctgaggaagaaacattaagttgtggcctaaaagatgaaaaaggaggctgatagtagtcctgtattttaaaagaaaatcagtatcaccgtaatttagggagggaggttggagagaagtggaaaatcagaaagagatagctgttaaaaggtagagccctataggttgtggcataaactttacagtaatggacagctattgaagagttataaacaacagtcaaataaatgttgtaaaaacatttattccatttgccatattgaaaatggggtacaggggccaggcgaggtggttcacgcctgtaatcccagcactttgggaggccgaggcgggcagatcacttgaggtcaggagtttgagaccagcctggccaacgtggtgaaactccgtctctactaaaaacagaaaaattaggctggtgtagtagcaggcgcctgtaatcccagctactcgggaggctgaggcgcgaggaatgcttgaacccaggaggcggaggttgcagtgaaccgagatcgcgccactgcaccactcctgcttgggcgacagagccagactctgtctcaaaaaaaaaaaaaaaaaaaaaaaaaggagtaaaatggagtacagggtattaggaagaatatataaagtacaataagatagacaaatgcaagttttatgcacaaatgaacatcgttagaactccgacacaatgtcttcttcccttcaaatgtcttcacttttccattcccactatcatccttcagcctagtctctaccaccagttttactgacgcgtcccccaaacggttccttcaccctcttctccaacctgctcccaagtatccttcatagtacaaggaaacaaattttccgaatcataatatttttcatttcatttttctgcttaaaaatttatcatgtcttcatattacttatagatggagtttgagaaaattattaaatctattccccacctaggttcgtaatcaattaagccgcacatataggagtcagacgaatagagatgaaaatatctcctttactaatgataaagctgttatcagcgaacatagcattaagtcttcttattatgtatgtttgctaataatttgcctagtgacatccattagtaagcattaaatggaagaagaagcattccctatataatttatatcatgggggcttaaccccaatttaaagagcatgaagccatacctactcaattcctcctccaaaaatcagggtagatggttcatttctgctttcttaattggagtacatggagggacagggaaaacgggcaatattattaccctagcgtagttctctccacaattggatatttgaaacaacaagcaaggagggtccaaagatttaattgcatatacattaacagtttttgtctcattttcaatattctttagagtttgcttattcaaacttcttgctaattatcatcacaagccgctatttctgtcattttccttgtgctgtccatattacttgcctcttcttttaactctagtaccaagattgactgatgataggccattcaatcttttccaaagccgaggttagcatgcttagctgaatgagttcgggcaaatttcaattttatgcggttcatagcaatagccatattaactagtatgtttatttgtctctaaataaggtttaggtattctgaaatgtctctctagcactggatttccagttaatgagcatctcactagaaatttatattgacaacaaccttattaatattaatcccctagcatttgcaagactaggacaaaatttcagatatcatttatatgatatttttgaagacattttataaatacaacaaatatgatggattatttctattactataactaaattatgttttgaaataccatactatttactaagagctataaaatgtgatagtatcctataaaattaatatctcaataactctaaaacatgtcagttgaaaatagtgcatatatattagtgtgaatgtatgtgggggtatgtcaaaagagaatctccttaatacaagcctctgctggaaataaaaaataaagaaaaaaagcagaaaatgaattatttaataatttctaagatgttctcaggtgccaacacaacaaatcctaatgaacccagggttgattaaatgcagataaagaagatatgcatttttcaaatctcatgaagagaaaaaagatttttctgtcgatcattctctaattaaagtattaacggtaagatagagactgtattccctcttactggaaagataaactgtatgtttctataatatatgtcaccctagcaacaacacacaaagcatcaactgcctttaataaaaactgattttataattaaaggagctaactgttgaaaaatagtcactttttatagacacttgaatatgaaaattggtttctcacacctcattataatactaagtgcaaattagtataagcctttgctcatccattccaagtaaagcagaagcacagacagatcaaccaacctagcactgtacatgacacgttgtaggaattcaactagttctgttaatttaaatacctgcaatagtttttattatatctgcactatggatttttaaaaaatatgtaacagcaaaaaaactaccaagaatatttataatataaacagttttttaaaaatattctttctcatgaaaaagtctatttaggaacttctggtaagggtaagataacttcgacccatttttcccttcctcttcccactaaaacagcaacaaatgctggtaataatgcaggaataaacccaagataactctgaaggtagtcagaagaagacgacggagttttggtttactgggtctggagcagaagttgagtgacttacatcttttcacttaatagaagcaagtgacccagactcaccatttcgagacccacaaccagcagtcgaaagcagcctagaaaggcttatctctccacatctaagaggattccctgagacaacatcaggttctcctgacactttctaggacaggatgggtagatgcaatccagagaattgccaacagtaaggggaaacactctctgttcctggtgggcctgcttcagctctcatccacagatacctgtgaaggagtaaaggatgttccatccccaaatatgccagattggtatgttggctattttcagttggaaactttggagaaattgtagtttcagaaagagttagctcacctgtctcttcctacatgcagcaaaccataaagattcctctgggaggggcaccctcacaggaccagagtgagaaaatagcccttattaccagagacttagaattggaggcttcaatggacctgaataaatatatttactgaagtaacccttatctttcactagttttatacccactatctatctcctagtgactcccctagagaaaatttactgtccctagccagattctctttatcctgtcattgctttccaaattcatcaaattcatcattcatcattaaaagcatcttgctttgactacttcttcaggcttcactttcttgtgatgatctccacgtacatgtataagtaatacaatttgtattcttttcttttgttttctgcctgatgtcgatttggtttctagatccaactgaagagcctactaagaactaaaagggggattggaggtgatatccaattcccctacacctgcacatgtgatgaaactgtacagaactaaatacacacacacacacacacacacacacacacacacacacacacacacatataggaacaccgagagaaactgaataaaattgctgaattgtagtaatgtcaatattctggctgtgatattatattatagttttgcaaaatattaactttagggaaaaaatggtaaagtgtacataggatatccgtattatttcttattaactgtatatgtatctacaattatctccataaaatgtcaatttttttaaaagtcaattttgatttttttattttctgtttggatttcactagatgttcttattgattttattcactatataattgagaatcatcttgctctgtgtttactcagagcaagctgaactttcagcaatcttatttttaaaaaatgctacatgatatgaccttatcagcaatttactaagttatttgaatggactttatggacatgaacttatcttcaaagcgtcttttctgtttaaagctatgtcctttaccgttttttttaaactggaagcattccttccctgccagctaaagaaaattccatgttattaaaaatggtggttctcagccataattaatacacatagttcataacacccatttaaaattggtaatgtgtttataagagaggtgagacatgcaagaaaagaagtggtaccaagtgatcaccagagacacatggagtgtgtgagtgtaggagagttatttaacctctgtgctatttatttatttacttatttgagatggagtttccttcctgttccccaggctggagcgcaatggcgccatctcggctcactgcaacttccgcctcccaggttcaagcgattctcctgcctcagcctcccaagtagctgggattacaggcacccaccaccacacccggctaatttttgtatttttagtagagacagggttttgtcatgttggccaggctggtctcaaactcttgacctcaggtgatccacccgctttggccgcccaaagtgctgggattgtaggagtgagccaccgtgcccggcccacctctgtgttttactttccctatctataaaaagggaagtaaaaatagtatcttctacttaggatagttatgtgctataatatgtgaagcccttatttcagagccaagcatatagtaagcacttccataaatattaattattattattactcatggaacataattgattcccattagaatttgtaggagtaaggaggtaacactttaaatctactttgttcagagctgcttctcgctggaaaccttttaagtagtgtttgtatcaccttttctcctagcacttacatagtgtactgcttgtgtaattaactccatggataaagaaatatccttccccttccatttactagctttttaatagtgcagcttcaggtcttccactagaaatattagaattgtcacttaattttcaacctcccgatatttaattgaaagatgtacaatataatttaaaaggtacctacccatagggcaactaattctgaaaacgggtgataagtgaataaaggaagtatgcttaatttcattttcatgctttcgcagtttctatcttatattgataaagaaatcctaagctctacatctgtataagaatgtatcatcctttcaatatacttgtatctatataaaatgcagatgtgtatattcttgtgtgtgcatacacacatgcacagctatagaatatagatattttaatttagataattttaggactttacataaaatgaatcacatatgcactattatgatgttttccccaatgcaagataatattttctaagattttagacataagatgtattttatcatgtacaatgcactctaaaacttaccaagtttccatttacaagggaaaacgattaaaaccacaaattgctatagttaagagtttgggattattttattttattttacaaatgagagcattcatttctgaatacctaccataacacatgcatacatctgtcagaaaaaaaaaatcatatttagaatccaagtttactcccggagaaccttaacctatttcaaaaacatctttgggaagatgtcaggaattttcacaatttctattacactcttctgatttgagtcaaagaaaataattttcaacataataggacagcccagggaggcgagtttcagccagttgctgtggaaaaaccagaggcagtcgctgtcatgcagctgccaacaccacagttgggggccttgccaagtagacagatgccaaaacagaaaaaatagcttattccaattaattgttgaaacctataaaggtaaaacacttcatgtgtgggcctgactacagaactgctttgtcccccaaaggcatcgtgtatttgcttttcattgtgggggttgctagaaacatagaaataatattattaaagtatagaagatgtccaaggaacatgcatctttcctctagcaaagaataatttaaaattaaaataagtattatacttattacttttctaaattgcgacttctctccatgcctcactttccctctctgtaaaatggagataatagcatcacactgctattttaatgagaaaagtgaaataatacatgtgatgtacttaatggtgccaagtagttagcatacatcaaacatgagcaattatattattcctattattataccaagttagttaaacttgtattattttactactaatatttgtattactgcactaagttagataaatcaaaaccattgttaaagctgatctagaagtaagttattagacatttctgtttaggagatatcagttacttagaaatttagttactataaataagtcttacatatagaaaattacctttttttggtgactttagaaatttagggcgtaagaaataacttttcaaagaaaaaaattatgtcatcattttaaagagctctctcagtgagtattaattgtgttcatagctagataaatgtgtgcacacacaacacattacggccaattcaaattttaaaacaatgccattatagtggaatttcatcctattctgtatgggatcaaagcatccagaggtctaaaaaacattaaaataaccaatcctctaggtgctttttaagttttcagttaatttgtcttatctacattgaagcaaacaatctaaaacttgcaatggatatctgtgaagcatacatcaaaagaaaagtatagtagctgttagttcaaggaactgaatgatagagcttccaattaaaaatacacacatgtgttgtttatcttatttcagtgaactaaaaggttatttgcatttcttgtaaagtgtgctcatccctttaagtttcagtgaactgtttgagaagacatagggaatgggaatgcattttattacaacctttccctttatttggaaagattattcggtagctgtttctgaaatgtctagtactactgtgaaaaactagtacccacaatatagttctagaaacagaatagacaaagttgcttctgatatctttctgtctactagtcaggaatgcaagacaatttcagatcaatgatccttctactatcaaaagtcatgggacctaaggatcaagatcacttttatttttgctccatttgaattatccaggcaaaaccaatgacataaatgaggccttacgtgacctgacatccctatgcctgatctagcaggactgtgacatcaacagtaaagctagacggatcaaaaggtgcctccaatgcccgtgtcagcgtcagcttcagcagaagctccccacttggcattcctgcttgagtgctttgcagtcctggcatgtcacctaactggctggtgcttcctaataggccctacaccacttctgattgatgtgtgaatatgcaaaccttactggaatccaggagccagatggcccacataccaagtatagcagccagacaaaacagaggcagattcagcaaactgttggagagttacatttttggtgattcctacagacacctaagtatacatagtcctatttaattgatttcattccatgttaacccacaacaatagtgcctctgtcattaaactgccacattctaattaaaggagaaaattctttcttttctcctttccatttagcatgaaatgaaggcttttataatcaacctgattctaccctgctacttgtagaggctgtcatgtagtctctaaaggcacaggtgaacaaaatctctttgctgcttctctaggataaagcagtcacttatttctttcattaaacttagatgaattatttaaaacaaaagccataacttgtataaaagagtgcccagatgagggtgtatcctccctgagtgagtaatatctagtatatatcagccacacaataaaaaatgatgaaaatggtaaaaattataaaatgataaaaaatgattaacaaaacacaggaaaatcatatatacatatatatgtgtatatatatatataaaatcacacacagcatgtctcataatgaaaagtagaagttacttaatatcggttttctttttttacatatgtaaaatatcattcatgggtgtacttgtgtgtgtgcacaaccacattgaatggagacatttcaattagaacttctccgatagaagaaatttaatccacaaataggaaaagcagtatatctcagcgttaatcacttatgccttaaaaataatcatgatagcaaccaaaattctttctggaatctgaatcagccacacacatgtgtttctgactttattcattaagattagcagccttccagaaatcactaaaatggaatcttcaaaagctccagttcaagatctggagataaaatgaaagtctggtgatcctttccatagactctgaggactttctttaccgtcttaatgtcttcaatggaaaaacgaccgtgtatgacaaaataataagtttgcttcctgagcttgaaatgaatggctgcctatcagatccactctgagcatatcacttcaggctgtcaggccagccacattgctcacaatttccctttgggataagctaatcctaaaatcattttatagtttggatagtttcagcatgagatattgatgtctttgtagaagttctattgcataacatatacatggaagactcaagttatacggatatgtatgtactacactaattgtgtagtgtgactatgtatgcattaagaattttaatcaattgtgtaaagggaagcaaatgttcatctttcatatctcaaccaatagttttggttctcatggaaatcaaacattacctttttgtaataaaatcagtgtttcaacagaaatatatttcacaatgaaccttgtttataatgaccatctaaaatttctttaagagatgggcattacaggtcaaagataatctgtatgaaaaaaatacataagatattataaaatgtagcttaaactgttgtgtattaggaaaaatttaatacaaattctgctataattcaaaaagaaaataatgaagggaaataaaagaaaagaataaagtggaacaaaatgtgtcacataaaacaacatataccagggtagggtactataaagttttatttctacagctttgaaagaagctaaaaactcacttgtgactctgtagctcatgagtaatgtggtcatttcaaacttatggtgataaaactttatggcactctagttcagaacatatgtcaaacagagaaaaaagtaaaaatcaaaatgaaatgtgacaaaacactgcaaaacccttctcatctgacaccactattctggttttgtctgggaatcggtggtcaatttcattttgaaatttctgtctcagagtcatgtagcaacttaaatgactgctctgattagcatcaaagtaagtgtagaaaaatgatttgctttcatcatgatggtgttaacaatatgtacttcagaaaatgtcatcgttagtgttgctaaagtaagaacagaagcataattcctgcagttaaattccaatctaagatatttgaccttcacacgaaaagaatgaagacaaagcctttctcttttaaaaactatttttatggaatatattaattttagagaaaatgtcatgtctttacaatgagagctcaatattttcaaatgatgtggttatatattaaatgaatacgttcattttcttaccattaaatttttggtattagttctgggaggccataatttttctacttaaatttttgcctgtatataaaaagtactttgtgtaaatagagtccaatttgactttagtttattagtattaattagttgtattttgtcacttggacaacttgcaaaactttggtgttattctgattgtcactccattttcttagctgtagggccagaatctaattaatcctattattaatagttgtctaatttctcactattctgttccttagcctaaaggtttcataactctgtatgaaaatgagaaaacctgtcattgattaatatatgtttgtttttgtattaattgtgcaactgcaatgttactgcacatagaaatgtaactccttgattgaggagcacattgccacacatggaatctccaaaatgccaagtgaaaatcaccactcttaagagtttatttcagagtgttgactaaattgtttggggacttctttgcctataacataaacttaagagtttttgaggtacttgttttccttttaatcaaatacttagggaattataagtgtcttcttagagaccatgctttcatgcctagctacagttgaccaactcttttaaaaagctttgtctcctgaaataataataggaacaaactcaacatttctaagagaagaagacaccgttatcaactgagtgcagtgtaattcatcagtcattgataaaatcatattctagattaatccaggattcattcaattatttctaccaaatctctttcccttcaagagagggagtggagttagttgtcatccaaaatgctaatccaaaataataagggccatttaagagaagttattgagttgctttagaacttgtagattctatgctatgctgtcactgtaagtagcattattttagaaaataaacccctaaaccttaatttaacatgaaatggttcataactacaaccacctgaactgtgatcaaatcatgtcacttagatccatgtaaagcagtacttactacacccctctcacctggagagtttactgaaaggcatacctagggaaaaggcattcatctagtgctgccccagtttgaaagcgtaccaaaaagtattcacacaaggtttgtgtcacacaaggagaaactgtatgtgcctgttcttgaaacccacagcagtaatggtaacagaagaataacaagaatacatatcttgattccatataccaagctttatcctagaaaaggttgggattactggacttaaaagaacatggtattccgtaatcagacaaccttaatttgggaccattctggagactgcttaccacagtgataattatacctaatttgttaaaattcattttttccaattataataataattagaaaactataaaagtatacaaatgcagtacgttttatcttagttttcttctacttcaaaattatatatattatctaaaatttgtttttcttttcaggttatttctaaggtactttgatttttgttaaataattcagtttaaattccacgtttttatgtagaaaaaaatcaaggatttgatttctcttatattcaaaagtgcaatcgttttctttctacattgagatgaaagtattttggagcataaacaatacacgctaaataattgcaaatagcttttaaaggctaaagtttgcaatactgaagagctaaaccagcattgtccattagaatttttggtggtgataaaaaacaaaaaatgttctatacatgcactacataacacgatggccactaaaaccatgtgactactgagcacttcaaatgtagctagcaaaatggaggaacaacatagtttcttttactttcactaatttaaattcaaaataattttttgccattgtctaatggctaccaaattggacagcacaagtctagaatttaattactaatacatgtatactttttttattggtacatatgtcatataaggttgtatgcgcagaagcatacagataaatggatgccatcttgttactatctaaaagccaacatacaaatgttttatgacttaaaaaaatgccacagattcttgcttcactttaatgtgaggaactcagatatttattaacataattttgaccaaaagtagcctccataccaaatgcaattatttagccatttctgcaagactggagattttttccccaaaaactaactagaaaaataacttaatcctctgttttaatatgccatttcacagcttgcaattgcttattgtgaatgctcctatttcttttcttgaaactttggcaaaactattatgccagaacatgatttacattttgtcattcatttaaaattcagaatggctttttatgccattaagtctatttatttacattaaagacaaatgcatacttaacaatttggagaaaacaatcaaaagcttttgaatcattctaattggtgagggcttattctttaaaaagtaacatctatttgatgtagatctgtgatctgacagaaaactaattgttttaagtatttgtaatccaagcagcagtgatgcaaatgaatttaattatcagtttaaaaatccaaacaatgggaagtaagacaacacgctgccttcaaagctatagtaataaaagaagtgctagtacatttcctcatgtacctggaaatgagtggcccagatttgcttgcactaaagtctacatgcctaattttaatcattttgattgtataatcaacttcccccagtcatttctaaagataaattaagatgcatgctttcattaagaataaaacaccctgatttcttcatatttctaaataacttgccttttccaggttttctgaggtaagaattcctgaatgatactcacaaaagtaaaatgtacactgaatctagtaattatatttattttaattttctttctttaagaacagactgttggccaggtggggtaatctcagtattttgggaggccgatgggggcggatcacctgaggtcatgagttcaagaccagcctggtcaacatggtgaaaccccgtctctactaaaatacaaaaattagctgggcatggtggcaggtgcctgtaatcccaactacttgggaggctgaggaaggacaatcgcttgaacccaggaggcagaggttgcagtgagccaagaccacgccattgcactccagcctgggcaacaaaagccaagctctgtctcaaaaaaaaaaaaaaaaaaaaactgtctattttatattgaatttgagtaaaatgcaaaatatgcagtgaattttactaaaatcaatgtattttactgaatattagaccaacgcattgtagttggggattgcccctttggcaaagctcccatttagttcccaactattctgatttatagctaatatggagaaaagttaggaaatgaagaatttttggactgacacaattataaaaccaagaggaaaaagcctacagtttttaaaccaaaaaacctaactttagaacccggatttgtgagtaagtagtttgagcaagtcatttagacaaatgctcttcaagctataggtcaagacatttgtgagctgtacaacccgtttatgtgtcataactgccattaatgtaaaaaatcaaatagaaggctggtgcggtcgctcatgcctgtaatcctagcactttgggaggctgaggcgggcggactgcctgacctcaggagttcaagaccagcctgggcaacacggtgaaaccccgtctctactaaaatacaataattagccaggcatggtggtgtgtgcctgtagtcccagctacttgggaggctgtggcaggagaattgcttgaacccaggaggcagaggttgcagtgagctgatatcatgccactgcactccagcctgagcaacagagactccatctcaaaaaaaggaaaaaaaaaaacaaatagaaaagaatgaaataaaattattaaagtgtggctacatatactaaaaatgccaccttttataaaacttttgttttatttctgcatgtgtctgtgtgttttggggggtactggatcatcaagagtgctcactttttctcttaaattggattgtgaacaatgtaggggagaaaaaattgatttcctcgcctatcacaaggttcatagctgagacccctatagcaaaagaaaggttaacaagagaaaagcatacaaatgtatttaatataaattttacaaatgataccaggacacaggagcattcagaaatgaatacctaaagaaaaaggggagacctgtgtatttttatgctaaatttgatgaagagtggacaacctggcagaagtatgattggagaacaaaagggtgtaatctaatggtaataaagttggggtgggggggaatgtagcaaagcctgtttgttcagtcttctctgtgtcccagtgtgacattcctttcctttaggtatgggacacatgaggggtcttatggcctacttcagagcaaggccagataattcttttctgatctgcttcagaggaaaatggtggcagaaggtcagagactttctcacttccgctgtttcccgaaatgccaaggtgccatatttggggatgatatgtcctaaatcccactaacaacaaatataaaaaaggtggaagcccccaatttaaaaaaaaaaaaaaaatagattgtttaatcatttgaacttgggaatcttgaaaatattaaaaagaatcctgattctttctccgtttagccttgaacaagttatttaactattctctgctttggttctgtcatatgtaaaatgaggatactaataatgtctatctcagtacgttgctttaagaattaactgagagtgcacatatatctttgacaaatcaattaaaatacctttggatatatatccagaagtaggaaagttggatcatatggtaattccatttttaggtttttgaggaatctccatattattttccaaaatgaccatactaatttacattcccaccaagagtagacaacattctgaccacaaaacataagttagtgaggtgatagatatgttaattagcttgattgaatgtttctgtaatatattcatagattaaaatatcacattgtacaccataaattactcaactgttacttgttcattaaaaataaataaataaggtcagtcaccgtggctcacgccagcactttgagaggctaaagcaggtagatcacctgagctatggagtctgagaccagcctgggcaacataggggacccccatctctacaaaaaataggaacattagctgagcatggtgggggacacctgtagtcccagctacttgggggttcaggtaggaggatggcttggaggtcaaggctgcaatgagccgcaatgactccactgcactccaacctgagtgacgaagtgagatcttgtctcaaaaaccaaaccaaaacaagataaataaatgcaattaaagaactcatgcaaatccattataacaatgcttgacacttaataaaggctagccatctgtatgacatctctgttctatgactttttagttacttttaggtttaatgtgaatgttttttctttctttttaacttaaatgccgtataaagcactcttttaaataatgtacatagaaactttatctaaaattcctagttatgtgattttgctaacaggcatatttttcatggaacaaaaagtcacggacaacaagccctcattgtccatttttctcatatgaatttctctgtacttgaaatgttactgtcaggacttggctctgccctgcttctatcatgcctgtcaccttattcaatagaaacaagatgagtgttcttggcattgggaagcaagaagttagtattgtaagtatgattatttcacacaatactagaaatcgttgctgaggaacagcctgcatattgccacggaagaaggctgggatcctgtaccctgagataggccaagtgaaataaggtctattcatagacttgtatggtagttacaacattggttgttttagataataatgtagacttcataaatcatctaacacttggaaaatattacgtaccatatagtaaactcttgaaagagcattttagtacccccagaacaatgcttgaaaatttaaggcaaattacttccaaatcaacacaattttgagtgtaacttaactctggcctttgatatggtaaactgccaattatagctatctagctcggatttaaattgaattagattaaactgtgacccagtgatttttctggtttcttatgtggtcagtgcaaacagttatatttaatggtggtaaagctgagataaaaacgttaaatgtaagagtcaattgcaaggtcattttctttccaagtaatgaaaacgtagtacttgatccgctgtaaaattacaggctaatgactcagtcctacagagtagctctcaaaccttgttcgatgtacccacactgatttaagcaaagacaaagtatcattttgacgattaaataatgacaaggagcataaatcacgtcttagatggtgccacaaaatacaaattttaaaggtctcaatagacatttttggataaaataatgagaaaaaaatgttcaatcaaaggtggatggtaaatatttacaaattttaaaaataaatatttataagtcctattacttaaaaaagtaatatagtacacattgtaatattttaagaaagttttagtattgttttctgaggcatcaaattccattttttgaaagtatcatgaagaaggatattaaagtactttagattgccctgccaactgtaggagaccgaaatatgccatcccaaaatatgtcacaaaatatgtcaagaaagcaggcttgatggccgcggtggctcatgcctgtaatcccagcactttgggaggcagaggcgggcgggtcacctgaggtcaggagttcgagaccagccgggccaacatggcaaaacctctaccaaaaataaaaaattagccaggcatggtggcacacacctgtagtcccagctacctgggaggccgaggcaggagaatcgcttgaaccctggaggtgaaggttgcagtgagccgagatagtgccattgcactccaccttgggcgacagagcaagactgtttcaaaaaaaaaaaaaaactagcttgcattttattgctggatttctcaagttgtgctcatagggcacaatggagaaagaaaaacatgttctaataacatattttcaaggttagccattgtcaaaagttttcattcactgaaataaaacagattaatgaatctataagaaagcatatgtatatttgcctttttctgttgttatttttatagatttaggaggtacagtgtagttttgttacatgcatatgttggatagtagtgatgtctggtcttctagtgaaaccatcactccaatagtgtacattgtacctaataggtaatttctcactcctcactcccctgccacaatctcaccttttaaaaaattttgtatttttaatttttgtgggtacactgtaggtgtataaatttctggggtacatgagagcctcccgccattttttttttttttgagatggagtctcgccctgtgcacccaggctggagtgcagtggcgcgatctcggctcactgcaacctccgcctcctgggttcaatcaattctcctgcctcggtctcctgaatagctgggattacaggcacgcgccaccatgcccgactgatttttgtatttttagtagagacagggtttaaccatgttggtcaggctggtctcgaactcctgacctcgtgatctgcctgcctcagcctcccaaagttctggggttataggcgtgagccaccgcacccggcccctctcaccttttgaagtctccaatgtctattattccattctctatgttcatgaaaatatgccactttgacacaggactattttgagctaaaggcaattcagaagaagcagatataagttctctgccctcccactatttgcctgaaaacagtacatacatttgcaaaggtgtccatcctctcctctctatcagaaaggacaaagtttgatcaccaatgacaactttagatctttatcagcccggagactgcatcagaggaatctacataataaattttcttaactagcctttatctaccatcagtttcccatatatttgccttcctgaaattggccactcatagagactcagggtccttttcccttgtcttgttacttctcaaaaaacgtattgttctttgtcagagaaatttattcatttttccttatatatctttcatgtatacatgaggtgtgtatgttagtaaactttattgtttttttcttgttgatatctcttttgttataggagtcccagttaagaaataaaggtagaggctagatgcggtggctcacacctgtaatcccagctctttgggaggctgagactgaaggatcacttgagctcaagcattcaagaccagccttggcaacatagcaagaccctcatttctccaaaaagtaaaaaaaataataaattagcccggcatggtggtgcatgcctgtagctaagctaccggggaggctgaggtggaaggatggctcaaacccgggaggttgaagctatagtgagacaagattgcattaccacactccagcctgggccacaaagtgagacccagtgtcaaaaaaaaaaaaaaaaaaaaaaaaaatcaaggtagaggtaaaattatgttttcttcccctatgcaatgtgtttcttttatttaaatgtttatttagcaaattgtttacctgatgaacaactaatctgagagtgagtagtatgagcaaatggcttttgtaaagattttctcaaatttacctgacttgagctaaccacattcagattttaattactttaaagttctctacctatttatatatatatatacacacacacacacatttgcatatatatgtttatatacacacacacacacaaatgctacatatatattctaattgttttattcattttctgtgtattttaactaacttattgagatgcttgaacaaattgaaatgctttttataatgcttttaaaaataatcactacatataacatattctccagtagttgaacaatgtaaagaatttcttatatgtatgactttattctaacattcatatttcttgggtacttactaaatgttaggcactcacagctagtaatgtaaaatggtgggcaaagtctcttccaaaactatagtttataggctaataatggaagctttaggacacttttccaataattacacaacatgttatagtttgaagtgtgaaccttcgaaacagaagttgctggaaattcagtgtccttacactattcgaaggatttatacatgcagaaccagaaaacaaacaaacaaaaatatctcagttaaaatcagtcacttcagaggaaacaaattgatcgcgatagcagtagggaaaattttggagaaaaaatgttagctttgaagcaagcttgtccaacccgcagcctacaggctgcatgaggcccaggacagctttgaatgcagcccaacacaaatttgtaaactttcttgaaacatcatgagatattttttagatttattttttttagctcatcatctatcattagtgttactgtatttaatgtgtggcccaagacaattctcccagtgtggcccagggaagctaaaagttctgacaattctgctttgaagactcccttttaagttggcaatgaatgtacttacatgattatgtaggtattgttacttaaatgtaacatgttacgtttaacatgtttaaacattgatgaccaacgcagaatctcagcactttgggaggctgaggcgggcagatcacgaggtcaggagattgagccatcctggctaacatggtgaaaccccgcctctactaaaaatacaaaaattagccgggtgtggtggcacgtgcctgtagtcccagctactcaggaggctgaggcaggagaatcgcttgaactagggagtcggaggttgcagtgagccaagagtgtgccactgcactccagcctgggtgacagagcgagactccatctcaaaaacaaaaacaaaaacaaaaacaaaaaacaaaaaaaaaaccgaaaaaacaagaaatgtcttctgaccaatttctgtttctggtctgtgcatttgacttgagcacagatccattgttgcatacttgaagcgtcacgtacacgtgttgagttaaggaaaaaaagtcacattttcttttgatcactctcccatgtaacttcgttgaaagttacctttcattcctttttccatatcatttcctgggctagtcttacataatgttcaaacagggatcatgtaacgaattccatatcagtttataagctagactattaagattggtaaatgtatattttgtgttttttttcttactgctttggagtattgaaaggagttttagtataggggtgtttttatactaaacatactttagtttacataatagagtgtacatttactatacatattttattcaattcacaattttttttaaatcttgctttgttcaatagtgttcattatatacactttgaacctggcttcaaaaatagtacatccttctctattttatgcattttatatcaactatatgtaattgtttcaaattaagattttagataatatcctgtcacattacacttaggttgtctgaccaatagtttcttaaagattcctctatagttacattttctagtttcctttgcaattaagtttagccatataactgggttctgacccatgggatgttggtggaggtgacaaaagtcccttcctgacttagtcagaatattctaagacccctctatagctatgctgtgtaatgtggtagccactagccacatgtggctttggagcacctgaatagtggctatcccgtgttgctgagatttgctggaagtgtaaaattcacaacggaatttagagaggtggtacaataaataatgcaataaataatactaattgatatagtgattacctgttgaagaaataatatttttgttttacatatagttaaataaatattattaaaattacttcacctgtttcttctcagtttttaaatgaggctataagaaatgtaaatactatataaactttttgcaatacatttctattggatgtgctgccaaacttctcaggattcctatatatctttctattctactacatctaccattcatttcttcatcattaattattctatattttttattataaatttactgtgcgctaggcactctaattattccattgtttattataaatctactgtgtgccagctactcttctaataatcacctactgttaagacacaggatgggacatgtgacttcatgataaaaagggggaaacaccctgatataggaactgaattttacaagattttttgtgctccaacttcagtccctgccagaacaagcaaaaggagtgactacaatgtgactttctaaatggttgtattgaggaccacagatgctgggtcctgcctattaggaagaatgggcacactgagttatgaaatgataaaagactcctgtgtctcattctttggccttcagggactgtggtgattttgcaatgtctgtgaattgcccagggcttcagtgactgtggtgatagttctaaaacagggacacacagctttaggaacagtttcagtctataagtctgactatatgtacttcctgttgataaactcatgcttttgtcagtcttttgctaatactgaaaaacactcatgaaccatcctccatttcccattattattcaaggactttagacattcagagttctcagacaattttttcttttgaagagaaaatgtgggtggtttctttacaacttttttgttttgtgtattattattagacactgtctaatgttacatagaaaagaattggttgaagacaagaaagacagcgtctaacagaatataaaataaagaaaaacaaaaccaaagcattcaaataattaatatgaatgagaaaggtatcatttggtttcgtttctactttggctagacagtttcagtacttctgacttttctcataagtctttttttctaatattttaagcattgtttctcttcattatcttacttaatctaaaacagttccctcaaaacctttttaattctcttttaaaatctctacttttatatcttttaaaaatataggcatcaacattatactttaatactaacaaattttactatagaaaattgtgaaagaaccaaaacaacagtcctcttgttgtaaccacaagagcttactaattcatttttaaaagaaattatattgcctattcattccccttttggttaccttcttgctcaagaagtaaggtactttgcaaatggcatagttgatcccagcacctagatatatacatctctaatcaagtgccttttctattcagaaggtaaaagtgtaggtgaattatcagcccaatataataagatcttatcagtgtgtcactagtggagggtgcccaggttcttggtgtcttgatcaaagaattggacaaaatgcacaaacaaagcaaggaaggaatgaagggatttatttaaaatgaaaagtacatgccatagtgtgagagcgggctgagcagcggctcaagtgcccagataaagaaaatcttctggggtccaaataccctctacaggtttcccattggccacttcatgctcaccccacgtaaatgaagtggtggcctgcaattggtctgattggttgtggaaagcaaccaatcagaggctgaagtagagttacataggacactctcctgtgcaaacatctgattggttgcaaaaagcaaccaatcagaggctaaggtgaagttacaaagttgcacttctgtgcaaagactgggcccgcaatcagtctgattggttgggaacagccaatttcccatctgctacacagaaaaggtgggaggtttgcaaagggagtagcctctggtccttatgttacttaggggtggaaagttagggttttgccttcagtttagtcctagggaagtcagcgtgaaatggccttaggttcccttcctccagaccctattctcctgcctcaaatgtgtgatatttttttctcgaaaaaaaaaaaaaaaaaaaaaaaaagaagaagaaaaaagaaaaaagaaaaagaaaaaattcctcagggacctctgcaccaggtgtgctaaaacagagcaacacatgaaaatgtacttccttttcctaatttttcaaaattttaaatttttttattttaatacttttgggggaacaggtggtttttggttacctgggtaagttctttagtggtgatttccgagattttggtgcacccatcacctgagaagtatacaccgtacccaatatgtaggcttttatctctcacccatctcctacccttccccctgctctgagtccctagagtccattatatcattcttatgcctttgcatcctcatagttgagctcccacttatgagtgagaacatacggtgtttggttttccattcctgaattactttacttagaataatggcctccagttctatccaagttgttgcaaaatacattatttcattcctgtacttccctttcaaccacagaaaacaaacaacaaatgttatcatttatgaagaataaaatcttgtgtattttggggagtggaagaaaggtagcacttcttttataagttagtgctattattttataacttgagacatctgattagcttacctataacaaagtggaaatagaaaatatataatatacagtaaactattcatataatgtaactgtttagaatcttaactatcaggcagtgtatttaatgatctttcaagttgcttcgtattttctttttgtccgtttttttaattcaaattattggtttactgacttagatgataggtttgttctttagcagatatgctgaaatgtcttatataaatagtctctgaataaaatcacaatatcagctatcataaaactctacttacatagctcgtttaatatattattagaaacagtcttcattttaaatgcttcttccagaatgtatgcacatattatatagtgaggcatacttaaatattaacaggacattgctgaccttccaaaattgtattcgatgtttcagaagtaagttatgatactacaatcagtaatataaagcattctgctatgactttattcttaaaagagagaaactaaatcacatttacttgaaaactggcatattgaaatgaaacatttccatcctttgtggagatagagaacgctccagattcttgaagagaccatcagagaaaatctaggccaacatttattgttactaaatgcataaatttctctttcagtatcaggaaaatatatgagtatgaacatctataaatatgttttaaaaattatttgaagcctttccaataaaatgacaggaagaaaaccttttaaaaaggtgtaactctacaagcataaagaaaacaggagaagaaaaatgaacaactcaagatgttagcaaattttgggaagtacttccttgccttatggctctaacaaaggctgcaggctcacccactatgttccttggccaggatgaagtatcatatattcttctaatgagctgtgacttctttcagtgtggaatgagacttaccaatgaatatctgcatgctaggtatactcattactaccagaccttcccagctgatagaaatatatttttacaaaacacattttaacaaattgttagtttttattgaaaatttatatttaatatgatagttttccctaagttttaatttataattttatgtttccctatcccttcatcgatatttatttttagtgtttttctggttatttttacttgtgtatttttttataaaaagtttataatcaatttatccaactccagaaaaaaatactacttattatattggaatgcctttaatttacacattaacttaaaaacaatagtttactttataatgttaagccatgcttttcaggaacaaggagcatctttctccttgatttccttttgggttgttcaggagagttttaaacataggtactgaaatttcttgttaaatgtgtttcttgtttttgctgttgttgctattgttgcaaatgggtgtgcaccatccataaaaacttctagctcattacctataaaatgaattttactgattttgcctgtaaattttatagtctgctaacttactaaattattttattggtatttgtttgtgttcatatttgtgtttgttaatattattgttttgtgtgatctcttgaggtaaacaattctatctgtaaattgggatcccattaccactgcttgcaattgttttgcctcgaattggtttatcttgtctggttgcaatggctaatattttcaacacaatgttaagtattaatggaggtagctgtagtactcatatggttttcctgtctttatccagaatgcatcagatgtttcttctttaagtaatgtacaaacttttggactttacacacacacaaacacacacacacacacacacgcatatatatatataatatgtcaacaaaattattcaattctgttttatattaaatgtactttaatcatgaaatagattttaattttatcaaatgttagtatctcacacttaaatataaaccaaaagctaagatcacttgtaatttgaggaatgacttcaataatgagaaacagttcctcaaaataaagcaaataagaacaaatgggaagaagacagaaaacatgagcaatgcaagcagaagagaattatgggaaaattataattgaggtccacagaaagttaggagagaaataattgtattttataaaacaaggtcatgacaatataaaaaaatgaacaaaaacacctataattgacatcctatttagtggtgagaaaatgaaaactttctcaggaagatcaggaacaagacaaaaatgtctctcttaccactctttttcaacatcatattggaagtcctagctaatgcaataagacaaagaaaatagacatatctattggaatgtagaaatgaagctgtatttcttcatagatgacatgaccatctatgtagaaaatctgaaagaatcgaaaaataaccctggaaataataagcaattgtagcaaagttgcaggacacaagattaatatataaaattcaattgtttcttacacaccagcagtgaacaagtggaatttgaaatgtaaaacacaaagccatttccactaacattttcaaaaataaaatactgaggaataaatctaaaaaatatacaagatctttacaagaaaactacaaaactctgatgaaagttatcagaggaactaaatgaatggtgaaatattcagtgttcatggatagaaagactcaatattgtaaagaagtcagttctcctcaagttgatctacagatttaacgcaatcccaatcaaaatcacagcaagttaccttgccttatatagacaaaccgtttctaaagtttatatgaaaggcaaaagacccagaataacccacacaatattgaaggagaagaacaaagttggaaaactgacactatctgactacaagacttactatgaaatgacagtaatcaagacagtgtattggcaaaataatagacaaatacatcaatagaacagaatagtgtggaaatagacccacatgaatacagtttactgatctttgacaaacgagcaatggcaatagaatggagcaaagatagccttttcaacaaataatgctgaaacaactggacatctacatgcaaaaaaatgaatgtagacatagaccttgcactctatcagatcagaagagagacaaagatcaagttactgctactggatttacaagttaacgttcactggttgtacacactcatacaatgctagaggcacttgtatcatctctcattgttccttattttttaatagagataaatgtatttattcttgttcttgaggataaattttaggagttgaaaataaatactccttccataaaaacatactaaaactaaaattattttcaatgattttccatgggaaatttacctatactttgccaccaaactctctcttgcaatagtctttcttatcccagtaaataaccatcccatccttccttttgctcaagctaaaactgtttttctccactctctcaatctccatttttagtccaccagcaaatcctgttacatctactttcaaaatgtatccaaaattcgatcatttctccccagatccatggacatcaacctaatcctagccacacgcacacacccagccttcattactacattatcctctaactcatctctctacttctacctttacatcctacattctaacttacattatttctggctactgttcagaactctcaaaatctcctaatctcccacaatgtacaagccaagacctttacaatggtcaataaggccctatctgatttgtccttctaataccactccacttgcagatcctaccgctcttcctcagtcactctgcaccagccatcttgactcccttgttatcccacaaacacgcactccctcctcagagtgtacatattcttccctctgcctagaactctcttctccaagacacctgcaagatgccctcctttccttccttcaggttttttgtatgcctcttaagtgaggcttttccaggacccactacataaaatggcaacctaccctttgaaatatccctattctacccttatcctgctttattttttctcttagcacttgtcactctctgaaattctatattctacttgcagagagaaaaaacaaacaagttgacaaacaaatatagagaacgtcagatagtttgctaaatgtttccctctttggtttagctcgctagctaacagggccttatgattaaagggacttgatctcttaactgttatattcaaaacactagagcacctgatatgaaatagatagagaatgtagacttcatgtgtatttctgtcaaagcatgtttccttaaatataaattatttgtaaaggataagaacttcaagtacagatatgatactcaaaatatttattctctgactgacataataactgcaggtaattttaataggactagttcctatgaaaagtactctccgtagaccttgtagatcgaagacatttttttttcttcaggccaggtaaactaaatcaaagaaagaaacatttagcaaattcatctgcaactctcatttgttctcattaaaagacagctaatgctaaaccaaagagtaacttcacacatttctaatgaaaaggtctcttagtttgcactcatcacctggccacaattctggacaagaccgaaagtgatcacttgtttattgatcactttttgtccatttttactattacttatctctgcatatagaactggcatagtgaaattagctaaattaggatacaaataagcaaagcccttttaaaaaccatactctgccttttatgttccaagatacatacaagtctgccctccatgtgcattacaagaaaggtttctacagttaaagttatatcagtacattactgtcagagtagatcttaattctttgtgttctggctaccatgatcataatttgaaatataattctaggaatccataggaatcttggtaaggttaaaaatgcaacacccttaagtgaagcacagaggaagaccttcagagtgtcactaaaatgaaatccttctgctgaagcaaagtaaagcacaaaagagagattgaaagactctgtaggtcaattggaaatgttttattcttaagaaaaatatatagtagcccatgaaaggattgcagtgaaagaaatttgcggatacagtcaatagtaatgccacaacgaactgtttttttctaacctttgaacacaattatattaatatctttattcatcacctatctgccctgaaacacaaaataactaggattgttaaaaatatatatatacatcagataagtatttttaagtcttataacctaaaacaactatatatacgtatatatacgtatatatacacataaatgtatacgtatatatatacacatatatgtatacgtgtatatatacacatactcatatatgtatatatacgtgtatatatacacatactcatatatgtatatatacatgtatatatacacacgtatatatacgtatatatacatatgtgtatatacacttatgtatatatacgtgtgtatatatacacacatacacacgtatatatacacatgtgtgtatatatgtatatgtgtctatatgcatacacacatatacatatatgtgtatatatacgtatatatgtatatatatgtgtatatatacgtatatatgtatatatatgtgtatatatacgtatatatgtatatatatgtgtatatatacgtatatatgtatatatgtgtatatatacacatatgtgcatatatgtgtatatatacacatgtgcatatatgtgtatgtgtgtatatatacacatatgtgtatgtgtgtatatgtgtatatacacatgtgtgtatatgtgtatatgtgtatatacacgtgtatatacacatgtgtgtatatgtgtatatgtgtatatacacgtgtatatatgtgtgtatatgtgtatatacacatgtgtgtatatgtatgtgtatacacatatgtatgtatgtgtatacacatatgtgtgtatgtgtatacacatgtgtgtatatgtatatgtgtatatacacatatgtgtgtatgtgtgtatgtgtatatacacatatgtgtgtatgtgtgtatgtgtatatacacatatgtgtgtatgtgtgtatgtgtatatacacatatgtgtgtatgtgtgtatgtgtatatacacatatgtgtgtatacgtgtatatgtgtatacgtatatgtgtatatgcacatatgtgtgtatacgtatatgtgtatatgtgtgtatatgtgtatatacacacatatgtgtatatgtgtgtatatgtgtatatacacacatatgtgtatatgtgtgtatatgtgtatatacacacatatgtgtatatgtgtgtatatgtgtatatacacacatatgtgtatatgtgtgtatatgtgtatatacacacatatgtgtatatgtgtgtatatgtgtatatgtgtgtatacacatgtgtgtatatacacgtgtgtatgtgtatatacacatatgtgtgtatacacatgtgtgtatatacacgtatgtatgtgtatatacacatatgtgtgtacatgtgtatatacacatgtgtatatatacgtgtatatatacacaaatgtgcacatgtgtatatatacatgtatatgcacatatgtgcacatgtgtgtatatatgtatatatacgtgtatatatacatgtgtgtatatgtatatatgcatatatttgtgtatgtatatatgcatatgtgtgtgtatatgtacatatgtgtgtatatatgtacatatgtgtgtatatatgtacaaatatgtgtgtatatgtacatatatgtgtgtaaatatgtatatatgtacatatatgtgtataaatatgtatatatgtacatatatatgtgtgtatgtatatccatatatatatatatacacattttttaaaaaataggtataggttgagcctctcaaatccaaaaatcccaaatccaaaatgctcccaaatcagaaaccttttgagggctgacatgacacacaaaggaaatgctcattggagcattctggatttcagatttttggacttgagatgctcagccagtaagtataatgcaaatattccaaacgaaaatccaaaatttgaaacatttctattttcaaacgttttggacgaagaatgctcaatcagtatcagattgattgattttgagtcttttaactcattcagtttttgagtatagtccccacaaaataaatcccaatttaaatcaagtacttgcattgattctcaactggaaaaaggtcattcccctttgagggttcaataaattcctcagtggggtttcctccaacattctctactacagacctgattaaattactgaaattctaacactgtggttctcaaagtgtggttctttggccgtcagcatcagcatcacctgaggacctgttagaaatccggattcctgggtcccaccctagacctatggaattagaaactctgactatgggcctcagcaatccatgttttaacacattttctaggtaattccaatgcgttttgctgcatcgttttggagtgtgcatggtatcaaacaactctacaaaaatggtagcctgcttgcttttccattttaggtctctatgtctattgccaaatgtaaagggtagacttcagaccaaattttgcatgaagcattagtggtggtggggcagtctaattcttctatcattgcctgttgttttagagcttcacagtcttcaatcagaagttgcaaattaacatgactaagccattatcttattgttggctcaaccagccccacaacaatataattcttcaagaatggcattatatgccctctcacaacctctcttcttcactcctaaagatctcccttgctactactcacctgacaagtcatacttctttgattattacacatttctacatgcaattccttctgccttcatctttcttgaaattgtctctgcgtagacaacaccagactaaatgtcaccatattttaaaaagctattatcctctccaagcaattagtcattctgtcttctatgttcccacagcatttctattgcattaaagattatgttttattttaattatttgttgatgcaattgtttcctttctcagatgataatctcttggagagggaaaaccatgttgggttatgccttcatcactgtatgacagtatgattagcacatagctggcattcaataagtatttgttaaatgttgaaaggttattttagtaaacatatatctctgataggatggtaccagagtgtcaattgttcttttctaaataaaaatgcttcactaatgtccatgtatgttgttttgctagaaagcaaaataaaatcagataaataatggataggcccatcagccataaagaattggtttttttgctagcaactatcatgctaattggtaaatatttacatatgcaagctaaatatgcttggcactgagaccactccagagaatataggtgtaatcaataattccaattttcttgtatcaggacatgataacctagagaccaaaacatttaccttctaaaaggaattgtcaagatctcagtaacactgggttgataaacagcaacatatttctaagaaacttctttactattaacaataagtgatttgtctttctttgaaaacagtgagacctatcacaatccatttttgtctcactaactgagtaatatcctttgttacttaggtactttgcaaagattgtttcaggaaaacattcaagggaatggttctcagtagattaaaccatttagtataatcatcttgattccaaacacaaacacatcattcgacaagtcatcttaacaccaagtgtagatgttagggagttcacatgccagtaaagtggtattttgaatttcgtataaaactgttttaagttaatattcaaataatcatgtaaacacaataatttgtttatgagtagtagaaataaaaagcaatgtttgaaaatgacaatatcactttagataactctactgcaaactaagtttacttcactcaccaaaacgcagtatgtaaaaaatattaacatttaaagtacaaacagttctcgacttaagatattttgaccttataatagtgtaaggtgatactcatttagtagaaaccgtattttgagtacccatacatgcattctgtttttcactttcagtacagtattcaatcaattacatgagctagctttattataaaataggtttgtgtgaaatgattttgcccagctctaggatagtgttaagccagcacatttaaagtagggtaggctaagctatgttgtttcgaaggttaggtatattaaaggcatttttgacttgtgatattttcaacttatgatgggtttatagggacctaaccacacaagttgaggggcatttgtattagaaatcattcagaaagaatcaactaaaaaacttcctaaacaatggttgcattttggggttactaaacattcaaaggtagattaaatcctctgtgagtaagcgagcatttaataccacctgttattgagtcttcactgtctccaacccccctgcctgcttctcataggacttatcaatttgatgatttgtcccaaaaatgcattattgggtaggtggaatttttgtcccaacaataataggtatggaaatatcatgagttttagagtccattttcttgggtcctagcttcatctctcctatttactgtgagcaagccacataaattcacattttactcatcttgaatacttgtatcatatgattattggagcaactaaccatatacatataattttcagtaggattattaacatcatggtatacataaacaaaaagttcccaatcctcactatttctgaaacgaggatttccgtaagtttcctgtatcaatattcatctctccaaaataattgcactaaataattcaattgttaccaaagtcttgtgcaggctgctcatcagcatccagagacatagttcactgtacgtcatctgctctaatgatttaattcttcctattatcagataaaaacaaacaggaagccaggggcacaggagccattttagatctatgtaaaaccttccatggcacaatagctctgctcgattacttctgttaaagcaggcacattgcacaatagttatatataaatgtgttagctatatacagatttagaattcacttacacaatggaaaggtacatatatattgttacctccttcactgaaataatgttttgccactttgtcccagtatcatccttttttaaaaacttctaagctcattttaaatatagaatatgtttactgggtgtgtgtatatgtatgtgtgtgtgtgtgtgcgcgcacgcgcgtgtgtgtgtttgtgtgtacgtgttgaggacatgaattggcatacagagtgtaataggatagtaacacatgaataaatgctctgttttccctgtttgatgccaagaaggtagccaaaaccataatcaataaagaaatgaacaagtatccagaggaaaatcacccttcaaaaactttagttctgaaaatctagattcatgttaaggattgatatattgtcccaactgaacaggctattgggatatgggagttaagattcggggacagtggaaatttgcaatcagtcagattaaagagaggtttaatgagcttcctcaaacacagggaaagggatgaagttgtgaaggccaacatcctactccctttacagagtttccaaatgttgtgctgagacaacctacttaaatggctgtagaggccagataccaagcacagagcatcatcagcaaaaccttccgtgttcaagcaaggcagggcattgtggacaagctgtcctttatgtagtcatgtttacttggctattaagcatatcagctatgaccaaaatgcactgaaaaccaggacacttacagtattctggactctacctggccctttggaatggaagtgggaagaagtagaagaatgcaaaatgttacggagattgaatttctcaccagtcagattgttggggttactagttgctgcaggaacagattcaaccaatgtagagaaacaaggaaatatggcttattacaaactaggttatagaatcaaaattcatgtgcatttcaatagcatcatgaaattatggagttaggaacacaatgattacaattaaaatatcatgttctcaagaagaccaggtaacatcatggaaaagaatagaagtaaataagaaggagagattcagtagaaaaaaattcataaatatatgcatttttcaattcaattcagaaaatacattacataatgacaaaaatgggaatattttgtgtttatatgatttactatttataatgcccttttattatatgttttgttacaagtaggcaagaacatataagaaaaataagactcagagaatttcaattttatattcacctttcttttcaaataaattaaagtatggatataacgttttctcctaaggtagagagtagtgtgaagaagcctgctttatcaaaaaataacgtgctggtggggctgcggagaaaatggaacacttatacactgttggtgggagagtaaatgagttaaaccattgtggaagtcagtgtagtgattcctcaaagagctaaaaacagaactaccattcaacctagcaatcccattactgggcatgtacccagagaaatataaatcattctattataagacacgcatacatatgttcattgcagcactatttacaatagcaaagacgtggaatcaactcaaatgcccgtcaatgatagactggaccaagaaaatgtggtacatatacaccatggaatactatgtagccataagaaagaatgagatcatgtcctttgcagggacatggatggagttggaggccattatccttagcaaaatgatgcaggaacagaaaaccaagtactgcatgttctcacttataggtgggagctaaatgatgagaacacacggacacatagaggggaacaacacacactggagcttatcggaaggtggagggtgggaggagggagaggatcaggaaaaataattaatgggtactaggcctaatatctgggtgatgaaataatctgtacaaccaacccccgtgacacaagtttacctatataacaaacctgcacatgtacccctgaacttaaaataaaagttaaaaaaagaaaggctaccttactgactcaaaagtttagtgttaatttaccctacatcatgcttatcatgctggctaaaaggtaaattaaaaagaaatcttgcaagaagtatgtcatatcaatttattttatcacatgatattgcccaaagagggtgagtcctggatttttaatgtggacatatatgttgcggcaatgaagaggtaaatgaactattgtggcaggccaggtctcactaatgcaggcctccacaacaactgtttcagcactgactgagtggtaaagttacatattaaaagctgatagagccagcgcccttaaacaaaggctggacggtaacaaaagcccaccaagagttttgcccaggcctttcctgggccttgaagcatgacaagataatgaaggaattcttaacaggacccttttagaattaaaaaagctttattgggggtctgaagaaactccccaggactccacaaacaagtttactgggcatctgaaggaactcccccaaactccatgatttagccggagataagataagggtaatcatcccagcacctggacccatttagataaagtaaatttactgaggctccagaggaatgtcttcaggaatcagatcttagttacagatcagaagaagttaatcatttatgtctttagatggatacacacttacatgtagacatacagcgtagaaggtatataagctctggaaaactttatagttttgagttggtctggggataatttccaggtcttctccctgtaaccacttacagaaataaaaactctctccttttcccgttcatctgcatctcgttattgggccacaagaataagcagcccaatcctcagtttggtccaggaacactatcatatcatgggcttttgtgaagacattagacaaaactaattatgcatttctacttcatttaagtcaaacatgcatactatgttggaaaaaaatcagacagaagagtgagtatggaaataaagatgattactaaattcagtataggatcaaaaccatcatatcactcattgggagatagtttatctctctcaattgagctggcagtaaatattttttcccataaaattttttctcaaacacaaacatcaagcacattttatgacaaaattatttttggtcatgttttcaaaactgtacttccctttattaagccggcatggatgagcaagatttttataatgcgaatcatatttgtcatagagtatacacgaggctttttaaaggattataacatatcaataaattacatggaaagaatatttactctgaattaatcttatctagaaatggttttgtgtttatgtggagataaatattgttcagttatctctatataatagatgtgataaatcacattctagtagaattttttggaatcaaagttaatagaagacttattttaaaaagagatagggcttatttttaaaatggtaccaggaaagtggaaaatcagttagatttactgcaaagacacatttggcttcaaatgacgccacaacaacaaggatacatttaatcacatttatttcctttaaatatcccttccgtagctttacaaaataacaaggaaatattttgttgtctctctataatttacaaatattatataaatgtgtgtataaaaggcaatgaaaaattatcatctgtctgtgtggtaaagtagacacagatagacattaatacgactataaaaatgaatatgagttagatttattagtgaggcatttttatagttgtatgaatgtgtgtgtgcctgtgtctaatttaccacacagacagaatttttcattctcttttttctctttttaaagtcttcttcaacacaatttttccacccagtttttcttctgtttctacagttagcatagatttaatgatttgtactactgacctagtatatttattatatttatatagtgtactagtaataaacaatgagattatatagaagatatacattcctgcctttgatgggctcacattttagagctttcttcataaaggttaccagattccctctagctcagattactgccttctcagaccacccacactgagcccactcagttctaactccatttatcaattaaccaaaaactcccaaataactgtgtaggttccatgagttcaggagattccacttcaactaatctgtgtatcctacagggctagaattctgctgaaaggcatgcagcgatgcaataaattgccaaatgatatatatatcacaattatgtttatcttttggtttcaccaagtggcttaaactgaatcaactagcttcctctaaattcccatcttcttcaaaagtgtctaaaagaatgcagtcacttagctaagttttgacagaaaagaataagaaaagaggaaaaagattctttgcaagttctcaaaattagaagttagtgcacaggtatatatacattttacctttaaataagttttctcctctgtctttgtaaacttttatttctattcctgacacctaggatatgcttgataatagaatttctgtacttgaaagaatggtgactctcctgatcagttataacagacttagggagaacatttgtaatataaatgaaaagtgtgagttgagttagaggatgcaaatattttggaagaaaacaataaatgtgctcatatatgtgaatattttacagttttaagatatgggcattcataaggacagaaaaaaatataccgaattgctctgaggcagtgctaacaatatataaatagaggatggattggatatcaagctttgatttctatattaacaggtgagttgtgataaatgataatggaaaaggttaatgcacagagcgaagatctatttcaacttgcgggaatgaggatacacagtacttgtcatgtttacacaccttttaaaaattactctagttcaattcaaagattcagagtattgttacatttactatttcagaaaatttcttcacaattctgatttgtctgtatgtttgtttgaaaatatgtctcttgtctgcttcagaattccaaaacttaaaaatgtcaatgatgccagtatatacagcaattaaactatatataaccatcttataaatattcggagaattatgaataactttcctaaatatcctaggtttactttttatttattcttctatatttgtgttgttatattttatttcacttagctaaaaaaagttgaggatttaaaaaacgtttttaaaatacatgtttctgtttacgtctgtaatagaaatttgttaattattcagcaagtaaataaaatgaacttttattagttaaaattcagtaagttaaattaaagagtacatggcaacattctactaccaaataccacaaagaatagacgatattctaaaaatgtttgtcatagaaaagggagaacttttgagattggatctcctagtggattgttttggctccattatcatgaattttacaaaatcagacccatagagggagtaattcatagctattaagagtttcaggcattttagtagaaattttcacttttagtgactctttaaatcattacaataagaaacaaaatatccactatcaaaactatgccactcttaaagccttgggtttaagggccatattttattagctttatttttccattatctagatttgatgtctcaattaagcaatcaatatatacatatacaaacattcatgatggaaacataagaaaaccgactcaccaaacatttgattgatttacccaaatcgagaataataattaaaatgcaagtcttttaaactttgacatcccaataaacctccatatattgcattcctaatactagttttcaaggtaagaatatcttgctctgtgtccacctataatcatctagagtcacgctattgattaaaaattgagttgtatttgcaaattaagtaaatattaagagtatggattgaagcctgcacaaaaacaagatgaacttattgtctttaatcatttgaaatatgctctaaactatagtggctgaatacacccaaagcaattatattgcttttcttgaacttggtaaagaccaagagggacaaaaaaatgataattttcacaacaaaattccctcatatcttcttctgctgggtgacatattctagctacttgatggaagattgcagctataaactctgaggactcatgtcattaaagaaactcacattgtcaagaagaatcaaagatatacattttatataattaaatagtgtatctttgccatatcttctgctgcttactccttaaataagagtgaacataatatttccagatttgcacagctaaaataaaatgacactatgagagaaataaaacggatttttaagatacacaggtacatagtccattttgaaaatttcacaacttagatcttaaaagtaaagtaacaaaccattcttaccttagaaaattgtgcatttacccattttgtgaatgttttcttttgaacatcttctctttcatctaaaatgcaaaataaaaaaataaaagttaggaagcaactttaaatataattcatattttacaaccaaagtaactttccattatgatgtgttagtgtttttttacatttagtattacattcattgataaatggaattaaacatgagtgatgctggtttggggcatccaaattaaaattacttctgaaaaatggccaggcgcggtggctcacgcctgtgatcccaacagtttgggaggccagtgaggacggatcacttgaggccagtagtttgagaccagccaggccaacatggcgaaaccccatctctactgaaaatacaaaaattagccaggcatggtggcatgcacctgtaatcccagctacttgggaggctgaggcaggagaatcatttgaatccaggaggtggaggttgcagtgagccgagatcatggcactgcactccagcgtgggcgacagagcaagatcccgcctcagatttgtaatatctgaaaaacaattaatatgaccaaacccatagtcgttcaaatactgtatgattataaaaaaatagtctcctctgaataacagtatttattcgccagttatgaatagatactccagtataattaaaagaaactctcagctgtcatttactccgaaaaactatttcggagcctttccccatgccatccacccaaccatggagaaatgattattccttcctttgcagcatctacatactctaacatgggcctgatctcactatggaagaggtttcctgatgagcaggagcatggtttagttatctttgcttcccagaacttagcacactgtctgaacaaattaagagctcagaaaatacatctgacaaatacgtgcatgctttaaggaaggggagattctacaactctaaaatttctaggacctcttttcatctaaaagtcagaacatttcaaataaaaatgcaaatgatactcttcatgccttacatataaatactcaaagaaaaaagtccccaaagatttatactaagggattagggagaaaaattattaaaaaacagcttcactgaattcatgcttctacaaatgatctttttgcccctaaactggaaattagtattaagtcaaatggacagaaaaatcatcaatcttgatatattaaaatgtttttctccaagcaaaagactatttttttaattattgtaaatataatcatattagttaatgttcagtaaatgaatgcatctgagagatatttaaaattgataaattttatattttatctacttggattaaaagaaccgttattaaaatgccctttacaaagtaatcatatttgctctcatatatttttcagtagtaaatctccgttgcttctcttaaaaacataaggaatcactttcgcataacaaatatatgcatgcaccaaaaatatctgtttatctttaaatcacaatactaatctataagtagattcctttagtcaatatgagaaataacagtgaataaataaatttcaaactgtcatcttaggtgagaaattttatttagcattacaaaatacatttttcttatttaattatgttattcacacaagcttctatatgtatgttcaatatcaacattattcatatggtatatgataaatcttagctacaatatggaagtatttcctttgttgacaagggtgaataaataaaaacagatagtaatagttttcaaacctattctagcctccttcaaatctttactttcataaaattaatactagcccttccaaaataattttaaaaagaaatggaacatttcaaatggtcaaaattaaaccatcttcatagactttatggaggaagattggtcaacgcatcatttatcagtagtatatacatatattcctaaaagtaaatgaccttatttgcaattccacttatatttcctacatgtgcatgcgtactttctgtcagaaagcagagagtaaatgagtcagttgaaagcatacattcagatgtctttgaaacatacccaaaaccctctgccaaaagctcaatatgaggtcttttgaagtgatttaatctagaggcttttaagtgaaaaatacgtagtagaataaaatttttattcttttcaattatatggacaaggagtaatttttaggtaagcatcgaaggcagcacgaaaaccttgacattatgtgcaaagtgttacttatttactgtgtaaataacactaaatgtgagcttcaacatataaacatctttgctagttgtcctctctcacctctacgtctttaatacaagaaaaatgtcttcaatgaattattgtcttattttggtatagtagcatatattttcttcaacataataattattaatacaattaattgtattattattataaaatacataacaattcttagtgccttactattcataagtttgttttaattatgtcttctcaatctgtatgtaatttactactttatacataaacacaagctgagaaggaataaagctattaagtgacagaaatgaacttgatacagattttctgaatcaaagtccatggcttttcacattgaccagatatctatcatttacattataattgcataattaacaatacagaataccataagataatcagagtcacaaaaggtgaacatattaacgcaaatgcaaaacaaccatgaaatcagagcttctattttgaacaactcaaggaggttccatgtatgttgtaacctatgtgaatagcgtcctggaatttggcaatgcataacttatttgtctgtatgaactgatctagaactgaataatgagccttctttaatggtgctggatgatatggttgttaatacttcaaataataatgcttttacatttactaattgatatttggtatttcaattttcgtcttatatatcattatggaaacattttaacatccaaaaatcaatcaaaatttttgtgtccacacttttaaattccccataaatacatatttcttataaccaaaataatattctttctttttcacttattttatcataaatctcatataagctgctctttccttttgtttgctattagagactaaatcacaataaacatgctcatgcactcacttcttttttgtttttataattgtcttcgaaaaaattatcagttcaacattatgaaaacctttatgacttttgctaaatatctttataatactttccaagtgatcacacccacttctactggtagcagaaagaatgaggttgggaattatcatctcagccgcaggtatgtcattcataggagtttcgttgctttagtcttttacggtattgctgctttgtttagatgtaaggagatccttgatgtttgctttaatcataattaatttgattactaatgaagtagaagatgtttcatgcatttatttattctgtatgttcctatttttgtcaaaatacttgtttacatcctggctcatttatctattgagcatttaatattttaaaattaattggaatgagataattatatattggtaattcttaaacatttcaagtcatgggctccatttgattatctgatgaaaataatgaaccttctctatagaaaaatgtctacacatacatatttgcatatagtttcatagagttcactgacctccttgcagaaaactcctataaccataaaatccaagttaacgatcaaaattaagctactcacttttagtcagtgaatggacatattttcccaagtggtcatatgccttttaatttttattttagtatgctaaaattttatacgtatttacttgaattgatatatttttattgctatttgtcatattgcttaaaagttgactattttaagctgtatacccttagttaacctaaagccaccatacatacacatcacacatatataaattgttctagaaactattttgatacgttaacatgatgtctatttctgtagtcacatagtctatagtaaaacatattaatgtgcaatcagcaacaaagcaaatgagaaaagaataaagtgatagctgttttattacaaaatgattatatgctcctgtttagtcatttcaagcagcacatattctatttcatttcctttagggtttgtttataactgattttattttactaataaaaacatgcatgtgcatattaataagagaggcaaagaagaaaatctctcttaggaaaatttacttgaaaactgttccctggagatgtcaagaagtgaagaaccactacttcataaattgcaaaaactgaccaacgttttattttattctctctacggggaaatcccatataaaattagctttctaacatgacataaaaattgtatttcctctcagtaatctttaaccccttctaataaagttatttttattcagtatatgtggcctttcatattttttaagattagtacaatgaacttttaccctgttattaacttttatattccttagtccctcaggaatataaatgtgggatatattaaattgcaatattcttgattcacaagagcaagttactgcagaagaatgatactgggcaaactgagggaacattaaatctgtggaactggcttccagtggctttgcaggacttattagaattgtggccttaaaattgccaagccttagcgtctttaactgtgaaatgagaatattaattgctctttaactcatggagctattgacaggatataatgagatcatttactcgtgtaataatttataaaataaatatttacagaatgcttactatgacctggacattgcactagttactgaaaatataaacaagattcagtctgggagagctcttagcctagtagataatagacacatcatagataaatatgaaacattttgcataaacaaaaatatatataaatttaaagcgtattataggagcatggagaaaggaatatgtagccacatgggtgttagaaaagatattttggagaaggtaatgggtaggttgagttcagaaggatgagagaaagtaaagaaggaataaaggtaggaggaggataaagatgaatctcactgagcagacagtaaggacaaggacagagtgataagaaactgaaagtacacgctcattcattatgcaattctgttttgttgcactctaaaatgtgagaaagggagtggcatggaatgaaattgcaatgagagttaggagcgagatgctggagagcctccttaagacctcttctctgccatcagataaacaatgtaagtgaaagcatttaaaaactgggggaaaaaaaaaaacagaaaaacagttctataaacactaacaattattcccattacacaaagcaattaaccataatctgtacaagaaaataaaatttttttgacacaaggtctcgctctgttccccaggctggagtgcattggaaccatcacagctcactgtaacttcagacccctgggctcaagcaattctctcacctctgcctcctcagtagctaggactctaggcacacatcaccacatctgtctaatttttaattttttttcttttgtaaagatggggtctccccatgttgcccaggctggtctcaaactcctggactccatcaatccttctgtctcagcctcccaaagtgctaggactacaggcatgagccaccacattcggcctagaaaaacattttttaaatgatatttccttgggggctagttaatatgttaattgaagatcttcatccctaatgtgacacagaaaatgtatctttaaaaggggaagggaatattaaagttgataccagtttagaaactcacgtagtgaagaaatgcaatgggatgagttaatttcacttaaagaaagaactatgaagccgggcgcagtggctcacgcctgtaatcccagcactttgggaggccgaggtgggcggatcatgaggtcaggagatcaagaccatcctggctaacacggtgaaaccccgtctctactaaaaatacaaaaaattagccgggcgtggtggcgggcgcctgtagtcccagctactggggcgtgaacctgggaggcgcaacttgcagtgagccaagatcgtgccactgcgctccggcctgggggacagaggagactccgtctcaaaaaaaaaaaaaaaaaaaaaaaaaaaaaaaaaagaaagaaaagaaaataaagaactatgaagtaatatgggagagcaattaagttcagtctattctctgcttccatcaaacatgagaaaaaaatgaaaaatatggaagattaatgataaacattagataaggttatgtgatattttggagcattataaaggaaggaaacaaatttaggacatatttagaaagtggatttactgtgccattaatattacaaaatggcagtgcagagtggaggaggctgcaatggaaaatggtatgaaaaatgctttctattaaatctgagtaatagtctttgattatgggatttttctaccgcctgaggtgacgttagtggtcagcttacaatgaggaggtctaaaataattaaacttctgcacgaagaacagaaaagctgttcatgtcaaagatatttctttatttcccattcgctttacagtcaatgtaatgcagtcttcactgctcatcatcctacaaaagttgttcttaataacatcacctacatcctttctcatttccaagagagtgactgtctggatcagagctgtaatcccagcacttagcatagaatgtgttacatagtagtgctcaataaaggtgttttaagttaacgaagaccagatttactttttagtcctcttctcatttttctcctctgcagatattaattctattaaactctggtaggcagaataatgcctcctcaaaaatggccacgtgctaatccctgacatctgtgaataaattatgttacatggcaaagtggaattattgcagatagaattagactttctaattagctaacttttgatagggagattatcccagattatctgagtgggcaggatttaatcacaggggtccttaaaaggggggaaatgttggcataaggggagaattagaaagcactatgagaaggacttggtccgaggtggctggttttgaagatgtacgaagaaggccgtgagccaaataacgtgggaattctctagaaaatggaaaaggcaaggagacagattctcccctggagcatccaaaagtacacagcccttctggcatcatgatttgagtccagtaagttccagtttggatttctgacctgcagaactgtctgagaataaatgtatataattttaagccactaaatttgtggtaattttatagcagcaataggaaactaataaattacatttcatatttaaggctattaagtgacaaatgtgtactgacacctactaggtggtagaaaaacaactgtgagaaaggcagtgtctctagcttttttccttctagcttagtgagagaagcagacacaacaaaagggtatgttgatacaaatatacagataagttgcctgatgaagaaactacagtcatgtgacaatcatatattaaggaaactaccttgaaaaatccagagcttccttgatgaagtgacatctcagctgagttttgaaagttaattaagagcagagagacaagtggtagaaaagagaactccagaaaatcaaaagagcaggtgaaagtgtcaggatgtgagagaaagagtatggtcctttcccagacctagagatggtggaggaggataaaaatggcagagatgaccctagaaaaagtgaaattatcatcaacctatttatgaagagcctgaaaatatagccagagggcagttcgaaatcaaagcagaattttaagtagggaaatagcaatgtcaggcttggcttttagaaataaatttcacagtgtagagaatatttggggataaactgtaaataagaagacacatgagctgattatacctataatccacgtgagaagtaagcatgacttgcattaatgaatggcagtggggctggaaaaggagtaggtgcattcaagatgtgtttacggggtagtattggtaagtactaattattaattatatgtggagttaggggagttggatcatggataatcaatgataaagctaaattccctgatggagaaactacagttctgttacaatcatatattaagagaactaacttgaaaaatccagagcttctctgatgaggttacaggctagattattcagaatggcatataagggccttcacaatttgactccagtgtactcctctaaacatattatcgattaggcctgttggcagtcacccatatcccaaaccttatatacatctaccaggtctgccttagtcacacaagccaaatttctccataaataaatcatatgctttcttgctttagtcctttgttcatgcactccctagaatgaggacactcactattaagatctaggtcgaatgtgagggttttcacaatcacacttatctccctggcataacttatcaatcaatccttctgatatatacatatgtgtaggcttttttctaattatgcatatgtgttacacacataaatactttaactgtatgtgtatggacacacagatactttaattgtgtgtgcattataatttataaagtgatttcaaatatctcatcttgcttacactcacacatacacacatacacacacacaaacagaaaattagtttgttgtcttccaataatgcagcccaaatcccactcattacctcctaaatgtgaccacacttagatgggagaattattatgtctttgcaactcctggcaccaaacatggtatactgaagcagaaataggtacttagtaagggtttgttgaataaatcaagtgactaatcaatactgtaattaaatctcagatctactaagtcctagaccaatgctttccccctgcacttcatcatactgctcaaactactctgttaattatagaccttctgtcaccaattcatttcctaaattatccattgagcacccattagacataaaactaactttcaatgacttctccccaaaatttagccttggaactgaaatattgctacttattttcatcactacaatgaataaaaaattaagagaaagaatatttcttgcaaacaatctgcctttatttctctaggtgaatttcactctgtaatatgatataattgccctttacttcatctttcatgactgtcatgcttctgacacaatgtaaaatgctatggatgacctgtctgttcctttgcctccactgcaaacgccacttctttctcaggtaggtcaattgcttttttattgtagggagttgttggactcagaaaccagattggaaagccatgtcagctcatattgaataaaagttctctcccattccctgccacttaatcacagaatttatgctccattagcaaattggagttatggtgagaacctaacataatcgcatagttgtatattcataaaaattgcaatgctctatacattggaaacatagcacaagtattgtagaaatatacttgtgaagaattaatcgaagttgcatgaagtaggacataatgacaatgagattgaagaaatgtattagagtggaagaatgatcagaactccaagagtatatgaaaaggtgttaagtggtctcagttggaaaaacagtgccatctggtagattgtgcaaacagttaattcttatcctcttaaaattgcatgtgttagatacaatgcaggccggggttacatcatacactcatttcagagtcaaataacctgagttccaactccagtttcacatctcattatctctgtggccttgagtaagttacttaacctctctgtgtctcattgcctctatttgtttcatggtaatagtaataaagatactgaattgtgaagactaaatgtgacacatgtatgacatattaatgctgagaaagagaaaaaaatagacaaaacctataaatctttacttccaaatatattacaacttcccgtgggtcttctgtataaatgacattatttcataaaatagacacgattgctacgtggcagccatgttaataattagtaggatttttatagtatttgtaaatatgcaaaaaattcaagtcttctcgatttgaaagataaaaacaaaatatgaaatgatattcacataaattatacctcctcatgctcaaaagaatgaagtaagtttttagtaataatggaaataatggatatttctgtggtgcattataatttataaagtgatttcaaatatctcatcttgtttaaacatgagtatgtgggtgtagacttgttaggagtaaaaataagttactattaattagtatgcagacttgaaatgtgctttggtagtgttcatgagaaagatgacttatttttgttaaagtaataaccatagactaattatgacagaataaatcaaaataaggtcaaggtctccagtgtaatttagaggtgaaattaactacttggatattgtagcagaactgctaactagatgcctgtttccatacagctgcctactcaatattacttttaaaagattcaaattctcccctgaaaatttaaaaaaatacattgttctgtggtgtatatttatctatttttatgggttgcaaaatacttctttgcaaaccaaaaggaaagcaaacagccaaatgtgcacgacacacaacagccatttccaaacatactgttaatgagatgctttagaaacagacaaatggtcaaacacagggcctggattataaggggatatttaaatcacaagatgtatttactcaacttacactatggagtaaaggttaataaaatggcatagtagatgaggataatgcctcatcccttatttcaccgagccatccctgagttcacctataactatagtgaacggattctgtggatgctgaagattcctcaccacaagcatccacatctctctgtttctttgtgttaaggctttcttcagtttaggagggcttggtaagcccatttgcagggcagtccagaagtgatagagatttagttctcccaggggcaaccctcaataaacgagggacagaagtctatgtattaaaaaggacaaaaaaaaaaaaaaacaatggaacaattgctaagcatgccctgtagggctcctcaattgttgcatgggatatgtaatccagaatggcccataggagcatcgttattgtctgctctctgtagtggaatttgggcccacatttcttggcttgatcatgcactagttatgcagtgttagaaaagactcataggccgggtgcagtctctcatgtctgtaatcccagcactttgggaggcccaggtggacgcagcatgaggtcaggagttcgagaccagcctgatcaacgcagtgaagccccgtctctactaaaaataaaaagattagccgggcgtggtggcggacacctgaaatcccagctacttgggaggctgacgcaggagaatcacttgaacctgggaggctgaggttgcagtgagccaagatcatgccactgcactccagccccgacaggagttcaagactccatctcaaaaacaaacaaacaaacaaacaaaacaaagaaagaaaagactcataagccacaccaaacccaagatttccagtctgaaaagaggaaataatcgtggtaaaaaaactcttagcttcactttgatgaggtatcctgtaaagcatcgaaagtagtcttaagcaaagacttagtacaaagtaagtgccaatagagatcagtattattattcctgactatatatttaattgcattagaacttcttgaacaagttggtagtttacattatttgctcatcggtttctttttcttcctcctttccacttgccatggttcaccatgggtggattacacatcccactcactgatgtggccttggtcatgtgacttgccttgaccagtggaacacagtcagatatgagagtgtgtcaattctgagctaggggcttaagaatcataaagtgttttcacttttcttggtccttcctccctttgtcaggggaagtacacgcctcaggtagcctctgttcctaaaaggagagatgcatagagctgacctgtactcaatacaaaattgaacctgacatgtgaataagaaataaatgtttgttcttataagtcattgagatttggatttgttttttacagagcattagcctataataaagctgactaatatagcaggtaaatagtaaatgtggcccatagaataaaattcaataatgatggaatgtatataacctcttcatttaaaaaagagagggttgtattccatcattaaatttaaaataagctgaagaatgggttttaaatgaagtattaaaagctttccaaaaattgccctttcagaatatattatcttttaaatcttggtctttctccttaccataccattcaaaatttaaacattaaaacaagcaggttgttctcatacatggccaagtattagcacagacagaaatcaatgtagaaaacaatttaagtggaaaataagttttaaggaaatgcagtgagttattgtaatagcaatggtcagtactgagcctgctcatttccaccttgtgccaaatactgaaagcacttaaaacagaaataaagtttcggagtaatcattcactccctgttcaccaaatacggaagtcttaagccagtgtttatgaaagatcaagccaaaaattataaataggaatgaaggccaaacatgttttcagcactgacgggaaactttgcagtcagtaaaagaacattagagtcagtcttttagaaaagggtttggaaaattattactgagaatacaaaagaaatcctgggagctaatcaaaagaggagacagttttgagagttaatcaggtgccaatgctaatagattatccaagtggcagagcaaagaaggtccagagtcacacaatcaatttttattcagcttgagttgctaatactgatgacaagtggttaacgactgcttcttccaagattcttaatgaaagacttctcttttctcaggtttattatgccactggattaaaaaaggtatttatttctgtactaagatcggtgacaggactacaccgagaacacgtccctcagtgtacattgccaatagatgagttttgtctatatcttgattgactaatcatttaatagatgtgagtgtaggttggcatgcaaattaagtaacttttggccaggcgcggtggctcacgcctgtaatcccggcactttgggaggccgaggtgggcggatcacaaggtcaggagatcgagaccctcctggcaaacacggtgaaaccccgtctctactaaaaatacaaaaaaaaaaaaaaactagccgggcgtggtggcgggcacctgtagtctcagctacttgggaggctgagacaggagaatggctgaacccgggaggcggagcttgcagtgagccgagatcgcgccactgcactccagcctgggcgacagagcgagactccgtctcaaaaaaaaaaagctctcatactagccttattgtttgcacttaggtatcactgagttgaacttgtagaggaaaatataacagaattacaaaagatttagacattgtagaaaaaatttggatttttattatataaaacaaacaatagattttgaggttttaagggaattttctgtttcgaaaaacagcattttaagtatagttttatttcatcttcataaattgtaaactttattttaaattctagtcattacaaaagactttaagtcaaatggcaaattgctttcctctatagccaatttaaaatgtttgaatggttatctatatatacatatgtattcaggttgtgttcatatacatattgttatatacatacataagcttcatacatatataacatataaagttcatatatgcatgtgtataattttatattctgatatgaatataaaattcatgaattgtagcacactgaaaacattagtttttgattagagaacattaaaatgattgtaaagtagaatctccagaatttccaaagtttgtaaattgaagacattcgaattttctaatttaaagatttgatcattccgagcgcctactaaacgaattataaagggaatggctttcctgaattacagtaatatggtagttttagctttgaacctgcctatctgggttcgaaaggtagttctgctacttattaacagtgtgcctctgtttcctcacctgtagaataatgataataatatcggtgtagctttgtcatgagctttggatgaatgttcccacttgaaccctggctctaacactaacttgctctatgggcttctgttaatcatttaattatgtggaatacaatttcctcaactttaaaacatagaatttggaaaagataatttctatgtgttccgccagttctaaaactctatcatctgcttctttattctaggtttttgtttgtttatttgtttctgcaggatgcagtttacagtccttgttggagtatgctctggaatcatacggcctggatttaaagtccagttttgccgcttactggctgagttttctcaatttatttacataacttttctttcctttagttttctcatctgtaaaataggtactaaaataataactatctcatagtgtcgttgtgaggactaaataagccattatctttatatggcatagaaagtgtctggccccaaatgagtaatcaacattgttattcctatcctgaaatctatgggctttcaatacgactatggaataaacccctaaaattgtgggcaaaattttatgagtgtgtatatatgagagtccacagtcatcagcagattctaaaagggctccatggtttgaaaaatgttggatgaaaaatatagacattattctggctcttatggatattaatgatctctgttttacttttttctggaacagtggcattaacagcaatagacctgtttttattatttttctttactttgcttttttttacatgtttatttaagagatctgctcttcatctctgtcaccattgtaccattctttttatggatatacacacagtaattggcactgaaagaggtataattatatacactgcagctatgccagagaaagccagggctccttatctggcctagggaataaataatgggttttcttcatattctcttagatattactcttcagccacctaggattgggcactatttttttgttgttgttagtttcttgtgcttccatatacacagatgcagtttcttgtcacccattatattgcaatgccctttctgaaaagagcccagcctttttctgtaatgtactttgacagtaagtattgacataatgtaatacagtaattggaactcagaaagatttgtttgctacctgactgcttaagatattttaatgccttaatcggacacatatttttaatgcacatttttctttagttagagcagcccatgtcatgaaggaaccactcaaatgtggaattgatggttttcacaggatataaaaaacatcatgccatacaagaaacaaatcactcctttctgcatagatacagtgaattcacagcttggaaaccagtattttcaaagcgtggtatgaaagtgtctgagaataaactctcagcagagatcagtagaaataaccagtaaccgctaaaagaggaacattattgattggcaaagtaatccaaaaaagagaaaagatgtgtgtgaacttaatactaaatttagacaagtattcattgattaggaaatcaaaattcaagataaagaaacatcttcagagattaaaagtagtctttcattgtttgagtaacctagctgaggagtcaaactaaaaccaatagattgtaattagtatgatgctttaggataaagttgaataaagagagcgagagagagacagagagacagatgcattatttaccctgatgtttatacaatgccaaggtcaattaatttataaattaaatttatgtttattagccaaattttagaaactagagaaaaagtgagtattaaaagctttaggatttaaagtttgatatatttcctttgcattttccttgcataattgtaattgcattgcacaagtagttagacaccttactttcttcatttaaaataacaggttttccaatgttgttcaaacacaatttaaatatctagaagcattgtcttctttgttcccataaaaattaccgttctgcttttttttggaaccttgaaaaatggtctcataatttttgctattaaaatagtcttgcaattactatcaatatagataaagcctccacccaaatgtgggattattaccttagaaaagagtctcaaaaattataatggatttaggtgaaaaatcatctccgtaagttttggtacatattttcaaattacttctcaaaaattccatattaaaccacattcctacctgtaatggatgaaaaggtctataacgttgcattgtaacctacattgaatacattaaatagaaatgtaattcatatgtaattcaatgtaattcacatatatgtctgtgtatgtctatctaaacatgaatgcatgtgtgtgtatatatatatatacatacatatacatatacacatacatacgtatgtatttaaagaatttagacttgggtcttagaatcaggctctccctgaatccttcaactgcgagatataaatataagggaatgttggcaatcatggtctgctacatgaggaacagcggaagccaatctgcaataaaaaagatagtttagagagaaggagatgtgacagagagtcctggaaggttttgattgcattttctgaggtgtactgcaatttgccctaacctgccttgagaaacattttaatccttagaataaacgtatcctttggaataaattccacatttgataaagatagttcaaatttggtataagttatttgtagccaagtgtcctaattaatactcaagtaataagtagtttactgcttaacagtagaattagttctatttcatataatttttccatctctcattcagatgggaagttgctctccttcctcttgtaaggtcatgatgctctatatctgcaaactcaagggagaaaaagtctcttaacttgaaactatacaggaaaaaaaaaaaaccctgatgtcatttctagtacttaattggtatttatctgccataaacacatgaagctgttttggtttgttcagttacccttgtctgcatagggccatttaaacccaaattggaattgtctctgggttactatcagtgataacaagaactttcaattcatgccaattataggaattcacaaacacagataggggtgaccaaggaatccaaccagaactttctgtttagtttcattagactcagacttaatgagaaaaaaaaatcattagcactgaaaaacttgtaagtcttgtttagtttcttgctgaaatttaaataatactgattgtgtctgtgatggaaactggtaaagaataaaatgaatatttaatttagtaaggtatacaaaacaaaacatgagagggagcatagctattcctaaatggaaaaataaattggtatactacaataggaagtatgatttccttttaatatgtttgttttatagaagttactaattgcagaaaccattttgatttaacatcatcaataaaatcaatgtgtgaacaatatcattacattcgaaagatgacatgtctaacaaaatggcactatcaatatatatgtatttaaagacagtctccctttaactttgctagacaccaaaagtttaaatgcacaatgccaagggcagttaagtgtcaaaatacaaatgtatcttaatattttatttaaggcttctattgttaaaaataatgcatctaacataataaagagggtatttgaaatttcatatttcaatatccccatggtttgccatagaagacaaatataaatacatgcatgaaattgtgattttattttcttggttactttttggttacagctcatcactttgcattagtgcatacctccaaacctccaataatctcatatgcatcattataaggagatgaaagggattaagaaataagtttaagtcagtgcatagaatattaaaagttcctttgcatctaatatgaatggaagtgattactattaatataaactcaataataaaataagcaaatgcctgcttttattttctcctaattaacaagtttaatcctttgcacttaatgttagttgtttgccccggagcccggcattggtagacatctcactgctcatgggccattcttgtcaccttgactcccagctcaactttgggatggatgtttcaaaccacctgcctcgatgtgttcaaactttgtgtgagagcatttttgaaggaatgtaattgagtatgaattatgtgacagtagatatgtgaattttgactgaaaagttttgtaaaacttgagaaatgaaccttttggctgggcacggtgactcacatctgtaatcccagcactctaggagctgaggtgggtgaatcacttgaggtcaggagttcgagaccagcttggccaacatggcgaaaccccgtctctactaaaaaacacaaaaattagccgggcatggtggcatgcacctgtaatcccagctactcgcaagtctcaggcaggagaatcgcatgaacccaggaggcagaagttgcagtgagccaagatcgcgtcactgcactccagcctgggtgacagagcgaggcttcgtctcaaaaaagaaaaaaaagaaaaatgaaattttttcttcaattttatagtaaatgaagaaaacatttcatttctccgaagactattttgattgacacccgtagcctatgggggtttcatattccctcttttccgttgttggagatatcatggtttaaatttttaggaagtatctcaatcattcataaaagtgtgagtattctaagttacttcaatgagatacaaaattttggagccctgcttccatgtttcaacttcaaaagtagaagtcagttcgaactccctggtgactgcacttgagaataaactatcagtcaataccacactccttatcttttctttttccttcctacgcccaccccaccccaccccaccaaacaaacaaacaaaacaaaaaggccaggacagcaggttctacacttttgaatgcaattttggacagtgtgccaaatctcagtttcaacatcacaaattaggtttcacaaatggattctgaatatacaaaatgcttttgagtcaccttttttcttcacctttaaattaaaagctctgaaatacaatgaagtgttttcttcagcttttcatgacttttcccattgggtgattcacagataacaggtcctcaatacatttttattaaattcaatttttaaaatatcacttatctactacggcctttctctaataaaaataagtattattcattgtttccatctaaagtaagggtaactgtaatgattaacatgtcgaatgtggatatcccaagagggtaaaatacttacgctttccatcataatcaagttcctcttctgcttaggatgtaaaaatgctatataagaacgttgctccacccaatgagaaaaagcagggtgatctataaaaacgtattattttttgagccatttatatagctgtggccacaaggcaacgaggtgagccaaagtacttcaatctcctccaaggagagactggatacatgaaaggtttacctttggcagggaactggaggaagaagtagtcatcgtaggagcaggaaaaagaaaatagctccaattgtaaggcattcttaaaagtcaggtgtgggctggtatgacatttcagcatccttggaaatgcagaccgaaggagtctgcactcattctggaattcttttccacaaacttctattgggaacttgcaaaaaagtaaggcgtaggacaagagataggaagaagctcccctcagtgacacacaaacatgaagtcaaacccattttccagaccctcctcttctaaaaggcgtaagatttaaggaaagatactaaactgaaggaaagatactaaactctaccacccatgggacccgcctgttcagaggggttggggaaggtagaagccactgagagagggtcaagataccctctttggaagagcagtatgataacctctttggcccaggattctgcaccaataaaaacagaatgatctgttaccactaggggagagacaggcatataaggcttgctgaaaactgaggatggaacaagaagatagaaatccctttaggaccgcagacactattacattaagcacgggatagcagcagcccatcagtggaggtctttgaagactgtagtgttctgaaggttgctacagcaacaacaacccccgcccctccaaaccagctcaatactaacaccactgactcaaaccccatactagcagtatgacagaaaaaaagctatacctatttccaagattaaacatatttacctcattctctatttttcttctatacatgacatctaacattcactaaaaagaaaatgagacttgcaaaaaataaataaaactaagcaaaatacacccattatcaagaagtaaagccatcaacataaccagactaagagataacctatatgcttgaactaacagacaaggactttaaaatatctctgactgataagataaggaatagattcatctagatactaaagaaaacatccaaaactttcacaaacagatgggatgtttcagcacagtgatggaatctgtaaaatgatgcaatggaattgctaacaataagcaataatcaactcaaaatgttaatgtagcaattgcaaaattatttctattataaaaaatgttaaattacaaagagaataacagtaccttaaaatgacacataatttaaaatactacagatgttaatattggaaaaattgtttaccaatgttcacacctgagtactcaatcctttgatggaaggtatgacactataatgatttattataaaaactccttaagtggccgcgcagcctgcgcatgcgcgccggcgaccaagcctaaatagctaccgcctctgcgcgtcgccctccacggttaccccggctttccgcccctccttctcgcggggctcgagggaccatggccgatcctcgcgtgagacagatcaagatcaagaccggtgtggtgaagcggttggtcaaataaaaagtgatgtatgaaaaagaggcaaaacaacaagaagaaaagattgaaaaaatgagagctgaagatggtgaaaattatgacatcaaaaagcaggcagagatcctacaagaatcccggatgatgatcccagattgccagcgcaggttggaagccgcatatttggatcttcaacagatattagaaagtgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgcggtgtgttcaagtagtatgagaatgtgattgtttttatctggttacatatatatttctttgtctaatttaatatgtcaaataaatgagttcatctaaaaaaaaaatccatacgtgatgtgtggtttatatttgtaactgcctatatgatatatattcttaccccaaccccatcccatcatatagataagaaaatgctacttatgtgctcaggtttacacaactcttagatgtctctgactacaaagtctttgttctttttaatgtacctctatgcctctcatactttaaaattgaaataaattaatctactgctccaaatgatcaattttccatggaaaaaaaagagaacttttgtaattgtaacaacctctgctatatgactaaacactgagccatgaggtgggctgccaggtaaattggaaggcttcatctaaaaagtacaagactgtgaggcatattcccttctcaacagcctaggatgattggatctacccattctgtcacattttcaatatataattcctgttcaaactttctattaatatatcatttcaagtttcattgatagtcctaaaatgcaacacaaaagacgagcagatgatttcagccattccaatttgcagccttttgtagaggggcatcaatagattttactgtacttgcataaagccctagttgttcttttcctattctatcatttctggattggcgaatgggataaaatgttcaggaaagaaaaaacaaatctcaacacaaacgtgaatgtcattgaaagctaaaaaagtaaacaaagttaatgatcacacccgtaagtgctactgatttttcattgaactcagaggagaaagttactggattcccaaaagtaagtgaagggtatatgtttgctaaatgcattcacagcctgttgctctaattatttgaggttttttatgtgttgttgttttagctgttgtttgtgttttttattctttctgcatttttcttctactgtacagttgttattcatgctatgagttatctaaagtttacattaataatcaaattccttgcaccatcccaactctgaaacacacaacttggatggagattaagactcattcaggactcaggcagacatccttagtacccagaaccacaacacagcacacacgaatgcatggttctataattattttatggagcatctatgaatttgctatgcaccggaccctgggaagtcaatgtacagtggtcaacaaaaacaattcaattgtattaatatttagaagccacaaaatgcaaatatattcttttttaatttgaagcttgttattcttctgcacaatctatagctcctattagaatcattaaagtacattcagcagcagtaacaaacgaacagggaaaatgtgaacatgacaaaaggctgccagagtaacacgggtgacaaatgtgggaacattttagaattcccaatttcccactctaataaaataatatgaacaaaaaggctttttttagtagcttcaactgaaactatcacctgatctatttcttaaaatcctcacgaaggtttcactgaaccattagaggtttgggcagtcaaacaaattaaacatgaaccaatctttttagaatgactactgaagtgctcagtatttccagccttccagttaccacagtgaaagaaacaaacaggtacttgtcaggtttataagggaatgatctattttctgcccttttttgcctactctttaaggaaaacacacacacatatgcatgcaagcatacacgcatgcacaagcagaacacaaatttagaagctatagagaaaataaatagaaaacaaagaagttttgacaaaaccaaactgtctttacttttagattataaaaacaatcaactcttttttttattattatactttaggttttagggtacatgtgcacaacgtgcaggtttattacatatgtatacatgtgccatgttggtgtgctgcacccattaactcgtcatttaacattaggtatatctcctaatgctatccctcccccctccccccaccccacaacaggccccggtgtgtgagggaattagaattttgtaattcatttgggtagaggagcaaaaggtatatattaggctcaacttttcagtcggtgatgagagacaaatggcctgccatccctgccctctctcacctaccccagttaatctaaatctgcaaaacgaaaggagcttccactaggccagaggggctgcaggatgggaaaacaatcagaatggaacactttcatgggcgttcctacagaccaatttgcttccagtcagcccatttaatttcatatttatgattgtttaaaagagagagcccaggcgcagtggctcatgcctgtaatcccagtactttgggaagccgaggcaggtggatcacttgaggtcaggagttcaagaccagcctggccaacgtggtgaaaccccgtctctactaaaaatacaaaaattagccgggcgtggtggtgcatgcctgtaatcccagctactagggaggcttaggcaggagaatcacttgaacccgggaggaggaggttgcagtgagctgagatcgcaccactgtactccagcctgggtgacagagcaagagtcagtctcaaaaagaaagcaaggagggaatgggacaattcataaaagcaagccccagcagttctagttaactgtgaactgaaccagtaagatgcacattgatttaacttcggaaataatttatgtgctggtttcttaaatgactgctacatattgccttcttacctgacgatggagtgcagaatatggggacaaaaataagagcaattccaaggaaatgctttatgcccgagtgctaattcagaaccatactgaaaaaggagatgcaagagaatgctcagcgtagattctaggccatccttaaacaatccagagctgaagagccgtattcagagataaatttattctgcgttcaatgtttcttgacctacttctcgtaaggaaaattctgcctgaataccagaaggaattcatttttcactttagcttgaaatttaccttaagataaaacacaatagttgtataaaaatatgccttatttggttatgcatataaagcagacccaagaggatttggggtaaaatatttcataagttgtactatgcatgaatataaaaaatgagaaacaaaaggatagttagtaaaaggctgttcagtcccaaataaaggagtaattgttgatatgctaaataaaaggggggtggggaaagtcctttttttacaagggaatgtgaggaagggaactcacatttgttgaggctgtattttgcatttaatcctcacaactaggctgagaacaaacattaggcattttatttcccatttacagattgtaaacctgaggcaataggattagttgcctgtgataacaattcacatgttgagaatcataatattataggcctccaccacctaacaatgccatcttcagaactacacacacacaggtgcgtacacacacacacacacacacacacaagtatttcgtgagattgtaaccacattcttaagttccatcctttgcaagtaaggtaagttaggcactgtttcctcactgccttagggttgtttataaatacagagctcttgaattacaaaatcaactcttgatttcactgacagaggtcaactgcttttagtgtaagtgaaccatgattctggcataaacagatatagaagaatcctgtttaaaagtttttacctgctctaggtgcctaccaagagaagaagagggggaagttgagagagttacagataagtgagagctagaagccgtgtgggggtgtggggagggtcctgaccctctgacacacacacacacaccttttcaaataagaggaacattataatgtcctcttagggaaccaaagtcctaaagaagagaaggaggttctggagctgctgaaaaatagtgcccaaccagagcaaagggactgggcatgtagattagcctcacaggggtctgagcatctcatcaggtttgtgataagcagctaacatgtgtcggtgcttgagaaggtcatggaagttaggaggagcaagctggcagtctttcaagggtgtggtaatcaggacacagacaccccaaatcctggaggcagaataggcagttcaactaagggcgggatgcaggtactggttcacttcagccaatgcctgcatgcaaagatcttcttccccacagaccacattggatgtcacatctctgtgtgtccttgacctagaatcagaagttggccctgatgccatgaagctaagtaatactcctgtgttattccaatcctagagtggaggctagagtcctaacaactcctgaatgtgaccggtagacctgaaaagtcactgaattttattaagatttcctgagaatggtatattaagaaacctgttaaattaaaagaggaaccaaaatagaaatttaatttagctatagaaaaattaataaaataccatttttagcccacttaaatttgtgtgatactgaaatttttttttcctgctacagatgtataatttagtgcaaaggtgtagggcccaaggcttcactgtgaggaatgtaaatgtgctccccaaaataatttatgattttgactaatgtctgcacaaaatactatagtccataacaggtttcaaatcttataacaactattaatactatcaacatgtagaaataagaaaactgaggcttagagtggttggactctatccattgattgcccaggataacatcaagtgactgactgggggctcaaaattgttctcctgattgtaaatatcaatcctgtttcctatacttgtccatatacttcctgatgcctatttggtgctcaataacttttagattgagtaaaagaatgaacaaaaacatgtatttatttagtgcccggaaggggcatagcaaataattgatatcctttcctatctcacatagcattcagtacagcaaagtaagcaaaattgaggagggaattttaataatgttgaacatctacaaattgctagacactgagatttttatgcactttttaagtttaatcttcgtgttaatccacattacatatgaggaaatggagagagaatatagtttgtcaaggtaatggccatagtccatataatttgagtgcttactatgtgccacctactaaacactttaaacacatgaacatacttcattttcacagaccttgtaagagaggtacttctcttgaccctattgtatggataggaaacaaagcttagcgaggttaagtaactgcccaagttcatatagctactttgcagtagatgagcacaaattgaaactcatgcttctctaactccattattaacccaatagcaggtgctgaaaatcactgatcgtgttgctgacaaaggagagtaaacaatagccacataataatactatctaagggaacattactgatgtacctagattttttaaactttcttttatttatgaaaataaaaatgaatatattcgattgtattttcattcttccctctgtttgtgccactttaaacactggtgcctcccttctctttgacccaaatactcaaaacaggtcacacatttaaatatggcaagccctccagccctgcaaatgatggactataaaatttgtttgtactactggcgatttttttttaaaaaagcttatgcacacctactttcatatttttaggttggacagtaccttagaaataaaaacaaaaattaaaacagatctttatcttttaaaaaatctattttccaaaaggaaacaaatgaattatttttgtcttattattaccatatagcttaaaaatcaattacctgaaatcattatcattcaaatctttaaaacaaggcacttaaatgtttaatcttttttaaaaacttagccaatgcaaaactgctttcctccaaaacgccctcagaattacctgcttctcctgcactcttagtatccccaagttattggcagtgaataaaagtgtaaaggaaatgaatcttgcaattctctgtgaatttcattccaaaaaagaattttaggcattttgatgaagcgatgtagggattagttttaaatagggatctctgatttgtgtattattttcacaatttgtaaacttactttcttccaaaagtgatttgaaataaatattctgaaacactgaagatcaatggaagctaagaattagaaatgcttatacaaatctattaaacctaactgtatatatgcatataatatttttgttaagaaacatagaattctttagaataattcaattttatataattatggatacagacacatagattcacattgtaatgtttattcagattttgtgtttatttgttgattgttcaggcaaacggaaactgcatttggtgtcaacagttgcatttctttatatttatattagctggttagctgtgctggcagaactaaaggaaacctgtccatagagccttacgtagtcgtaactacaacacaatcatgtgtcacaaatttatagcacagcagacctttacactgaaaattgtttagagaaagaaaaattcgactgggagcggtggctcacacttgtaatcccagcactttgggaggccgaggcgggtggatcacctgaggtcaggagttcaagaccagcgtgcccaacatggtgaaatcccgtctctactaaaaatacaagaaaaattagctgggcatggtggcatgcacctgtagtcctagctattcgggaggctgagggcaggagaatcgcttgaacccgggaggtggaggttgcagtgagccgagatcatgctactgcactccagcctggctgacagagcgagactccccatctaaaaaaaaaaaaaaaaaaaaaaaaggagagagagagaaaggaaaacttgaaaaatgaatgagaactggtaaacaactgcagggaaagtaattaccacactcttcatatggcaaactaaagaaagggggcaccgcaagaaaagtattgccagagcttgaagggcagaatgtgtaattaggatgtgatatctggcagtggtgattccaatcattggggattaaaactgtatctcaacttgtgctctttctgttgctttagggccagtgtattcactcaatcttccatgatatctatatggactcactgaacctcagatcttaacttcagttgagcagaactagtcttctctctctcagaccaaggaaggcataacttgtgttccatgaagcctactgtgtcaagtctgccaaatgaaactttaaatatgtaggcattgtctacttagcctgaacactaaaaagagtcctttctacagttcccaaggatttgtttggttgcaatgtttctaaagtcagtacagaaacttccctgaaaatggagctccaaacttatcacgattttcatcctggaatgtatttaggtttgtatccctcgacgtgcaccactcaattgacgtcacatactttttacctgaaatttatttcagtttctcagaagactgtatatttccccagttacagattttactattccttaaatatggtggctgccactttcttaacctacagtattaatggcagaaatgcttagatttataaaaggcaaacatggggaaaagagagacaatattaaattcaagtctctcgaaaggaaaggaaaagataatgaaaaagcaatgtaaaaaatgagagataggtggggcaggtttaagatgccattgaatctctgcatagactgcctttttttttgctctaaatactaaacttgcctaaattaggccacctccctccagagaacaaaaggaaacttggccactatggaatagtaccaaagtgaatttttagaagctattattacccactcataatctatatttttgaaaattaatatatatgtatatttgtaattatcaatattaatacgaagcaatagggtcaacatgaacttggatacttctgttaagttcacttaaatattgaactaatctaatcacttctcattttttctttaaccaaatatgtaaattcaatataattgacttagttctcaaattggttcaataaagtgttcccacagtatttgcaaatatattcgtctttagaatattcctccttaacctttttaagtagaaattaaaatagaaatattaaaacgtgtatttaaaagtggtcttttctcttaacagacatttactttttcttacatgaattggtttagtttttttttccagcactgaaaccattccaaaaaaaactgtagaaaagagtgaatatttattctattggatgtttgttatgtttgcataataactaattagtgaattgaggccaactttgatcaaaatgtttgctctgaatagatatttgctaataaataattttttcatgtgataagtgtgtaataataagttctctatgctgccttgctttgatagaatattcagacaacatttataaatgactaattcaaggaattaaaaggtcttaagtgccccagaatgtagaaatggaataaacatgtggtagtggtgagggtgggctagaaatgattaaactagattttttttaaaaaaagaagcaaaaataccgctggaaaaaatgcacgcagaataaatgtcattatgaaatattctgaacgtgtgtacttgattttccttcatcacggcttcattttgagacgtccaggtcaaccactgtcaaccaatcaatctctagcctctttgagcagagatcaagggcaacagcagagccttaatgatttcaacctctagccttcaagggcacagattacagggactgaaagtaaatcagtccatcacaaggcacttcagcccatagcccatgacaaagcttgattagaatggaaaagtgttaagccatcaaaaacaagacacagctataaggaaagaggaaatataaggctaatgaattttagtgttcataacaagataaaaatgtgtttctcaatacctgtgtagccatttagaaatctaaagagcaagaagaaaattatgatagaacattctgagcaatttcttcctcttttctcaagagcagaattgagatagacttagatgtcaagtctacccattcttctaggccgttctcagacccattttcaaaaaaacaataaatccaaaagccaaaagcaataaacttgtttaaatactgaagttcacatggtgctcatgttttcagaaatccacttacactttacacccataatgtaagtaacgtaccctttaaatatttaactgctcactaatgtttttatttgcatatcatttctttttaaaactagataacacacacttttttagcagatatctttggatcttcactatctcaactgacttttctttttttttttttttttgagactgaatctccctctatcgcccaggctggagtgcagtgtttcaatctcggctcactgcaacctcctcctcctgggtccaagcgattcttctgcctcagcctcctaagtagctgggattagaggcacccaccaccacgcctggctaattgttgtatttttagtagagaaggggtttcatcacgttggctaggctggtctcaaactcctgtcttcaagtgatccactggcctctaactcccgaagtgctgggattacaggagtgagcccctgcgcctggcctcaaccgacttttttagaccacaggtaaatgttagttttacttaatgattgtaattattttgatatactctatatggaaaataaggaaagtattttttcccttttaaaataaggaaaatatataattacgctctatttttttttttttttttttgagacggagaccggctctgttccccaggctggaagttcagtggcacgatctcaactcactgcaacctccgcttcctgggttcaagcaactctcctgcctcagcctcccaagaagttgggactacaggcaagtgccaccacgcccagctaatttttgtatttttagtagagacggggttttaccatgttggccaggccagtctcgaactcctgacctcaggtgatctgcccgcctcggcctcccaaagtgctgggattacaagtgtgagtcaccgcgcccgacctaaatatcctttaaatctagtgtatctatgtgactataatgatgagaagtcaggatgccttccctacagctaaacaaagacttttctgaaatgtatatttggagacccagaatttcaccttatttgaatgcaaaacacttagaggaaataaatcttaatagaaatgatttttacagcatttcgaacacaagaattgtagtttaaaatattgttctttaaagctataagtaaaccaatgtttccaaactgttttttctagagcaaaatttcctagaaccaaaataatcttgaaattttagattaaacaaagcaaaacagattaaatcacctccaagtttctcagaatcttcaacatacaaatggctgttaatatctcaaaaaggaataaaaactgtttttccaaatatatacgagaatgactttttttctcccctagaattagctattgatgccaagctcagtgtttctcatatagtttaaaacacacggaagtaaatttgctgttcccttataaacatatcctgataatatggaaacatttattcaactaactaataacaaaacaggcaacaaattaaaactgattcaaaggggaattcaagggactgaacacacatagtcacagaaagaaaaagaagctagaacaagattgctaagttagaaacaaaacagattaacatcaaaaagtgcaataaaattatatattttgagggtgccagaaagatattacttgtctctctactgaacaaaaatgtgtacatttatgtaaaatttctcagaatctaagccctaatcaatagtaaatactatagggtgactatagtcaataataacttacttgtacatttttaaataactaagagtataactggattgtttgtaacacaaaggataaatgcttaaggtaatagatgccccatttattctgatgtgataactatgcattgtatgtctgtatcaaaatatctcatgtgcttccaaattatatgcacctactatgtacccacaaaaaaattatcttttaagttagtactaagttatacaaagacgcatgtccctaacaaattaaactatctgtcggtagatcttttagacaatactttttagtatgataataaaagaacatctacttgttcttttgccttatttccaagttttagagtttaacaagcttgaatgtgtcataattactcatttaattactcacgtaattacttaagtgtcaggcattgtgctggggactagggagatgatagggaactggataaatgcccatactttttagaagcttactaatgagggataatgacatgtaaacaggaaattgcaaagtggtttgatgtatgttaaaacatagttactgtgggccgggcgcggtggctcatgcctgtaatcccataactttgggaggctgaggcgggcggatcacgaggtcaggagttcgagaccagcctggccaatatggtgaaactccgtctctactaaaaaaatacaaaaattagccgggcatggtggcacgcacctgtagtcccagctactcgggaggctgagacagaagaatcgcttgaactcgggaggcggaggttgcagtgagccgagatcacaccactgcactccagcctgggtgacagagcaagactccatctcaaaaaaagaaaagaaagaaagaaaacaaaaagaaaaaaaaatagttactgtgggatgttgagatgacacacaagagatattcctcctgtaacgtcaattctaggtatgttccaaaaaggagacatcacctaaatgataaactggagttagctgggtaaaaagttgaggtgggagatgacatttccagaagaataacagaagctagaatagtgacttgtatgacatgattagtacgtacaatgtcgttcttgagggatgggtgggttcggtgggtgggaaggggtgaatgtaaagagatagtgcagaggccaattaatggagagattggtagagcatcttatagaattcagatttcacttttggggcaatgagaatttggcataatgagtagcattatctgacttacattttaggaaaactctttttgataacaattgggaaagtggatttgggaagtttgaagaagggaacgtggcaaataaagagacaaggaatcaggaggctattgtaatcactcaggtgaaaaggtggtataaactaaggtaacagccatggaaacagaatgatcacatcagttaattgttcaacttacatacaaaccacaaatccaatcaactaatatttcaaacgtgcaaaatatgtttggcaggggtttattacgaatgtttctataaattatgtctctatacacatatctatacatatatatacatacacacctatatgcctatatatatattccatagttttgtgaaagtgatggtataacaacaaaaaatatattctgtcatatccactgatcacaatagactttgtgcctctggttattttgcaaatcatttaacaattagttttcatttaaaggaagtttataagttaaagtaaacataagacaaatttattcttgaatgttaagccctcagcatcgaggaccatgaaaatactgattaattagtgtgacgaaggaaaacattgaattaagtcaactagttattcagttaaatttattttgaagaaaccgcagaaggttttctagggggaagatgacacaatcgaatatgctttttaaaacattctggctgcatgtggaaaactgaatcacaggggtgggggaaattgaacatctgttttaggggaactgcaacaatcctggcaaaacatgatggctgatgccaaggtaatgttagaacagtgatctcgagggagaatgcaagaatgatacccccaaacctgagaagtttggcacatgatgtctttcaatgagctagagaaggaggaagaattgcttagaaggcagtttttgatctcatatatactgattttgaattaactatgtgacatacatgagcataactgatgggcagggggataggtctctagctcaaaagaatgattttggttggatataaaaatctgagggtcatggttaagagttgttattgctatggattttgatgagatcaagaaaaatatgttgattgagcattaagattgaagctcaacgttaaaagagatttacgataggagagcaaccctccaagaaaatgataaagttgccctgagacaggaaaactagaatagtggaatatcttagaagccagggaagaagagtttttccaataggaaggaccgatcaacaatcaatactacagagtggtaagatgaggcctgatgtgacttgggccgtgacaaaatcaatttcagttgaaggatgtggaagcagccggattattggtgtttgaggtagctacgtgagtaaggaagtagatacaatgagcatagaaattgttaaagaagtttagcttcaggagtggaaaataacaagtcggtaggagattaaaaactaatagcagaatgtcctatttgttactacaggcaacactgtattgcaagttaaaataaattagttaaacctgacacaaatgcctgaacgcaagaaaaaaaattaaagggtttcttcaaccagacatttgtattttaagcattttattttggcaatcaattggggaaatgagatattttctcctcaaaggtaatgctgtagcagttataattgtattccaggacttgcgggctactattacaaatactcatggaaattaatgaatttttatccccctggctctggaggagtggctgaaagcaccgtgttttatagtctgacaaatttgggttctattcccagtatctctggataccagctatatgaccttgaacaaaatactgagcctctttcaaagcctcagttttctcatttgtaaacaaagcagtaacaatagctcttttatagaatcatggagaagaataaataaagtaatgaatgtattgtctactacactgtctctcaacctagagactatatcaaaatcccctgaagaacttcttataatacctctcccagaattcattatctagtaggtctccgcacagcccgagaatttacatttcttacaaatttccaggtgatattgcgggtctgaaacatactttgagaaccacagctttagcacatagacagtcacataacaaaaaccaatgaatgtaaatattagcatttctttgatggagacagccccaggctgcctacagcaagatgttcccttaggttcctgaaaatagaaagtcccgcatggtcctcatcaaagtccgctggattccttcaatacctcttcctcttttctcacatgggcattaacatccccactcctctaccttctaactcaattatctgacccctgcgctcttttttttttctttttcttttcttttttcttttcttttcgagacggagttttgctctctttgcccaggctggagtgtagtggcacgatctcggctcactgcaaccactgtctccagggttcaagcgattctcctgcctcagcctcccaagtagctgggactacaggcatgcgccaccatgcccggctaattttttgtatttttagtagagacggggttttaccatgtttgccaggctggtctctaactcctgacctcagatgatccgtctgcctcagcctcccaaagtgctgggattacaggtgtgagccaccgcgccccggcccccctgcgctttttataaattcattcattcattcgttcgttcattcattcaataaactctgctacagtattcagagactcttttctgccatatttgctttgatctagttaacacttaatgagtttatataccataatatcccttttacagtatcctgtaacgaatctctttatcatttctagcttatatcatggagtctgtgacagacaacaagattgcctctgaaccatgccctctactgatgtgggtattattatactgatgagatttcttctttctcgttctctgttatgaaaaagcaagctcatggcccacggggctcataaaaaatgtactaaaggctgagagcaatggcaactaatgatatacgtgtaagtacatattgatcaaattagagatgattttttttttcacagctcagtgatgtgtctaacaatagtattctgggaaattccatatatacataatataagccatggctttattcagatagaacaaatgccagataatattgttaggagcttctacaatagcaaaattcaaaatcacattatcattttaaaacacataaaatggctcactttttttttcttcagtgcctgtccatcttgtttagaaaagacttgattaaagccacatccactgataggcaatggaagttagattagatacttgtgtatccgatactgtttaaaagactggttctgttttataatttgaattaaatggtaactaatctttttttttgtaggagcttgggctaggcaaagtaaggaataaagaaataaagttacattttctatgactagaggtattttagaagaagttgaatgcgtacttaataaaatgtgtgttctatggagattctacgcatgcatagaaaactaggtgaaataaaaattctgcacatttctgtaagcaagtatcaaggaaaaagagttctgaacaattgcagcaccctgtaagtctccttcatgctctttcccaattcacactatattcccaccagcctctcaggaagaaactgctctgctgacctgaatcattatagataactttggccagttctcaaacttcatatagatggaatcacacagtaaatgttcatcttctagtcaacattgtgtttatgaagttcgttcatattcttccaagtagcaggtttttattactatataatattccacggatatacccaatttttgttttttgtttgttttttgtttttgtttttgagacaaagtctcgctctgtcacccaggctgaagtgcagtggcatgatctcagctcactacaacctctgcctcctgggttcaagcgattctcctgccttagcctcctgagtagctgggattacaggcgcctgccaccacacacggctaattttttgtatttttagtagagacagggtttcactatgttgaccaggctggtctctgactcctgatctcaagtgatccgccctcctgggcctcccaaagtgctaggattacaggcgtgagccacctcgcccagtctataccgcatttttaattctaattctgagggacacaagttatatcaggttctgctattatgcaaaatgttgctattaactaccttgtgcatgctattttggtggacttaatttctccccttttttgagacagggtctgactctgtcccaggcaggagtgtagtggtgcaatcacggctccctgcagcctcaacttcctgggctcaagccattctctcatctcagcctctggagtagctgggactacaggtgcatgccaccatgtcaggctaattttgattattattattttattttttttttttgtagagatgaggtcaaactatgttgcccaggatagtctaaaactcctggcttcaagtgaccctcccactttggcctcccaaagtgctgggattacaggcatgatccactacacctggcctactaatttcttttgaacacatacatatgagaggaattgctggctcataaggaaggcataaatttagatttagtagatattggcaaatattaatttacacttaaaccagcaatatttgagagctccagctgaggcaccaattctccccaatacttgatattgtcttattatattttaaccattcggatgcatatataggggtattcaaaattctttgattactaatgaagttaggcacctattcaaatgttttttaccatctttgtcctcttttatgaagtgcctgttcaaatattttgccaacttttaaaaaatgggttgtctttttattgatatgtatgagtttattatatattatggatacaagttttctaatcagatatacgtcttgtgaatatttttctcccagtccatgacttttcttttcactgttattagtgtattataatagatagaattcttagttttaatgaagctcaatttatcagtgtttgactttgtacttagtgcttgttcggtcctaattatgaaatctttgcttagcctgtatctcactcgtagattattttacttatgactggagattgcccaccagatgtaaccacttacacactaatggtcacagccatattctccttgactatgtttacttaatcaccattggcagagactatgtctcgtctaatattcttttatcccttattcagagactctcatattattgtgactgtaaattttcttagctaaaataatttccctctatctctctctgtctcactttctttctctctctctctctctctctccaactcccaaagatatataagtcggatttattgggcacagctaccaggaaaaggggttcaagaagggttacagagcaaatgaataatcttttgctagggctgaggagtccaactcatggcctcgatataatttttgagaatggaagctgggaatagaagatgtcagggaaccctggggttgttaatagtattgaaacaacctaccttgcagtacttttgagagagatataaaaccatcaccctgttctgaagctcgagccctagcttattattttccctttatcaattcacaaataaaagcaatgaatttcctacaaatacttcttcttggttttgaaggtatgttatagaatagaaaaagtcttacaaaggtgtattttcacatagtggttggtgatggtggacagaaatttttaaaaatcatatgtacccttcatttcatatttttataacaaaatgacaatttaatcaatgtattaaattttcaaaagaaaatgcaaatatctgttctacatagattgaagaccaagaatttctgccagtgatacccagccaagattagttttcagttagtctttttataccatctttcaaaacaaatggtaatgtgcgatccttatactgttaaagaaaaaattattcaatgtcacttgctgaatcacggtaaggcaggctttattcaagaccatctcaataggtatagggaccgtgaaaatagggtcttgcagtaggggagagagattgagctcaatttgaatacagcacaggcaaatgggaattttataaccaaggaacagggtaggggtcagtggatggaaaattattaagaggaagcatcatgggtaagggagactcctgctgaaaatagtccagtcatcccctggaggatggtggatgatgaggaacatgatcagatatccaggataatcaaataccaaggatgagtgttttctggctaaactgatctggcctgctaaaactaaattttaggagaatgtgcacagactgggctatgagaaggttgggaagcctgaataaattttggccgagcaaataatctttgtcagtactaacatagttaataaacagagagtaccccagtaattcatttatgaaaatgtgtttcaaaaaattccagtctcgaccaggcgtggtggctcacgcctgtaatcgctgcactttaggaggcagaggcaggtggatcacctgaggtctagagttcgagaccagcctgaccaacatagtgaaacccctttctctactaaaaatacaaaaaaaattagccgggcgtggtggcatgcacttgtaatcccagctaaccgggaggctgaagcaggagaatcgcttgaacctgggaggcagaggttgcagtgagccaagatcatgccactgcattccagcctgggcaataagagtgaaacttcatttcaaaaaaaaaaaaaaaaaaatccaatctctttgaaagttatgtatcacttgacaaaaacatttcctttgtgacgtaggttcagaaacattgggttaaactaagttaaacaatttttttaactacaaaacatttcagggttgagttgtgactcgctaaagaaggaaatgaaattatcacattttaacaatttgtttttcattcaacatcttacgggatcaatgttctttacaatttccatttggaaatgctgttctagactcatccgttatataaattatacatttaagaggatgttggttctaaatactttaacttgctatcaaggcagaaatttaaaagcaaatttgctcttgttacgttattctcttttatatccaagagaaaaagaatgttaagttgaaagttattttgctcagggacacttacaaagatatatacacattcagtagacacttgcatgacattacatttgaaattggatatatcttttagctttttatacacagatcatagtatgcagattttaagtggtggaaaatgaatcttttaacattcaaagtgatgagctttggagaaggctgttttaatctgttatactgcaggtgtaactcctggtacacttgtaggttagtagtgatattgtaggcatattcgatggatcaatatatatggagtacttgatattcagatattcagttctccccgatgccttaatctgggtgttgtttttgcagtggttaggaggaaggagaggaggtgccaagattcagacactgcagaagaggattatataagcagaaataattccatgatgcggttttgtacctgtttactacaaatcaaaggtggctgacacaactttgtccccaggaattctataatggttagacgatagctgtaaatacgctcctgtgttccttccagaggtgtgtgggaaaccctgagaatggggtgtgcatttgcccctagttaagggtcaacgaaatctaaggcagaattcagctacaggtttagagctatagtctctttagagttccaggtgtcccttttacttaaaactctttttttccctgacattttaaatataagtttccctattcactttgcaaagcttagttaatactgatatgtaacaaaaattattcgctacacttgagcatgtctcttctccataaagatccagctttagatagcaactcttctcatagatctgtaagtattgtgagaagataattaaaagtttgattattgtccatataaatagacggtaagaaaatacacattttcagtattgaataaagactttccttcttctcagcagaagttgattgtattccagaaaaggaaagaatccttcctttcataagggcaaattaaaatgcaggaactctgaatttgggagtctgtttttcaagatgaataatcatctttggcaataggattcaaatggcacaacagaaggaattgaattgatattgaataatctgaattcttgatccaacctctatttttgaatatgtacatttaagatcactttgtgcatttaactctcattatgcataattgcataactggacaacaatatttgtttcttcctggaattcaaggagtttattctacaatttttgtttttatttatttatctatttatttttgaaagatggagtctcgttctgttgcccaggctggagtgcagtggtgtgatcttggctcactgcaacctccacctcccgagttcaagcaattctcctgcctcagcctcccgagtagctgggatcacaggcgtgcgccactacgcctggctggtttttgtatttttagtagagatggggtttcaccacgttggccaggctggtcttgaactcctggcctccggtgatccacccgcctcggcctcccaaagtgctgggataacaggcgtgcgccattgagcctggctattctacaatttttagaaaggtagcaacttctttccccacatgacattaagttttttataatactaaatatgaagctttaatgcaccaaacatacttgcaatcatcaataaacatatgacatatctctactaacaagcagattggaaattatggcatcaattcaccatctgtgccacacagactctagttttgaaactcttatttgaaacagaaagttatatatgagcataagaggacactgcacatggagttcttctaactttatgtgtaaatttctacttaatagaatatatactgttataagctgcttcacttattgttaaacctatatacatatacattaataaaaagtcattaatattgacctacaaataatttgagttttaaaaaattattattactgtacttcatttttggaacaggaatcaaattataataaaactagtagcacagaaacagacaagattactttggttaccagagactctgccaaattttcaatgataatttacatatgaaaaaaatagaagaaaaagtagaaaatgttaccatggcagtaaaatatgcatgtatttgaggatgatattcaacaggacttacctgcaacaaatataaaaagggaagtggaaaaattcactaaatcccttaaaatgttaagtactgagggtggaaagtaagatagataataattataatttttcctagaatgagggtaaggctcgagttatgaaaacactaacaccgtcagagtaagtcttaagggagaaccacttctggaattccctggttttgctccccggctgatgtacagaacatatgtctctagaagaataatcaaaggcattacaaagaaccctctcactaattgctgatagttacagtacagtcctagacacccatagaggcagttctttgcccctactacacatcagaaccacctagagagccataaaatattacctaagcccataccccaccccagaccaactgaatcactatctctatgccggggcttgggcatatggttgaaaattgcagtcctagatgacctgctacaatacacacacacacaaacacattttcaacttcatgtactctcatactttccacttcacgcactagcacttgttccctgtaccttcctaagtccacttagaaaatcagattttacatttttaattttttcgtgtgtgcattttaatgaaagagtatcactaagataaaatgtgacagtaggcaaccaatttctttcttcacagagcattgaaaatagacataattgattgccttagattcatgcccatatatacatatatatgcacatatatacttcaaactcattttgatagggcacagtagtgatttcctggtgtaataacaatccgttcatttttcatgtaacattgtctatatgattttattatactttttatacatagaatgaaatatttgttaataaatgaagaactaagggcactcactctatagcaaaaatgccacctctactagtaagaaaaagaaataaacattttctattattgcggcaactttctaaaaggaaaaaaaaacacaggaagactatcacataatgaaatcctttaattgttacttctttctctatctcactctcttttgtttcatccaagaaaactatttaactattatatagtgatatgtaattagagtctttcaattaaaattgttaagctacagattgttgacaccaccgaatatacttgattaaaataagtatagatgtaaacaaatgtaaacagaattgcacttaaatgatattcattatttagttcatttatttaaaatgcattgatggccagacgcggtggctcatgcctgtaatcccaacactttgggaggctgaggtgggtggatcacctgaagtcaggagttcaagaccagtctggccaacatggcaaaaccccatctctactaaaaacacaaaaattagccgggcatggtggcaagtgcctgtagtcccagctacttgggagactgaggtgggagaattgcttgaacttcagaggcggaggttgcagtgagccaagatcgcgccactgcacttcagcctcggggtcagagagagacttcatctcagaaaaaaataataataaaataaaataaaataaaatgtatggaatggccaaccaccattctacgaagtaagaactgaaagtctaataagcaaaggtctctacttctcagaagctctgttggatgatacaggtttgtgtacaaatattacattaacatggaaaaagtgctaacatgcagtagaggaggcataaacttgctcgattaggtttggtggttggaggttttacaaaagagatgatgaggcaaattggtgtttacctacacttgacagcccccacccatagttagtataaaatgtaattataattttgtgtatacagtacttgaaaaattattacagccaatcacaatagtggatataaaaattccaagtctatttacaaggaaaacattctggccaaatatgaccataaatatttgtgcttacaatacctagaaatttcaaatgtttgatatgttaaatatttttatttgtagagttcttcactttcaaatatagattacttttaatgagatagaaacaattatcagtttgattcattaagggacaatatcactttacagaaatttacatgtatttattaacatgtgaagcactttagtagataaaaaggacatttttgtatcacttaaaacattaggatgaaattatgaaatgtacatgctgcctactggcaccaaagattataagccggtctcacaattggcttttcattatataaagaacacccattatatgcttggaattcctatgccagcaggcatacagcaaatgctggaagcccattgttcataactttacttcttgccaagcatttcagttatattttctttggttatataaagggccagagctattttaagtgaaagaggtagccatcctcatctcactatatgacagatgtcatattacaatgccctacataatagtatgcaagggcaatgctacctccttcgacctggtgtaaaattccttagaattacaactgtgtgtttagacaataaaaccgaaggatttgcctcaaatatcaaaactaagtgcaaatgggcaatgctatatagatgagcaggaaacatttctcactctcctctaagtgaatgctaatatgatttcatgaattgacacaactaaattttgctttataagaacatacatagccaaaggatttaaaaaaaaaaaaaaccaccttaaaacaagttacagagggttaaacggaagcaaaagtaggtagctaagtattaggaagggtggaataatgtctaggaaacgagagtaataaggccaggtgcagtggctcatgcctataatcctagcactttgggaggccgaggcgggcagatcacttgaggtcaggagttcaaaaccaacctggccaatgtgatgaaaccgcgtctctactaaaataaaaattagccaggcctggtggtgcgcgcctgtaatcccagctactcaggagggtgaggcatgagaatcgcttgaacctgggaggcagaggttgcagtgagacgagatcacaccactgcactccagcctggacaaaacagtgagactctgtcaaaaaaaaaaaaaaaaaggaaggaaggaaggaaaaagaaaagaaaaaaaggaaacaaaagtaatagactaatcttaggaagctggctggagtagaatggcatagagcccccaacggtaccagcaatgtggggtaggtaggactcagctcctagatcttcttatggtcctcaggacataagaagcacactaaaaggcctatagaggatagatgatgcccatttaaacctttaattctgcctaaagttctgccaggtttatgtacgggcatagtgcacataaagcatgcataagaatgcatattttttgccttgcctttagtttttccaggttttcatgatattaacaccaacgattatgtcagagttatgctttgttttttctcaatgggagaaatccaagcataggccccctaaagaatgaaatgtaaaacaatgactcctgcctgatacaaccagaaggaagattgacaatacaacatgaaaagtcacggagtaaattattttcatacaagtggagaaattattttcagggaattcgtagaccgacagctattcacaggccatcaaacacccataaggacctttgtcatccttcaatcacttcagtagagagagaacatgtatgaaagagacagaaaacacagttaaataagcaattcctgttcagtaagtgtctgcagggagtttttcagagtgtgtacggataacacgtatacctactcgatcctacaagtgcgtggttctgaacagaagcaaatttgaagtattaataacaatgaagatggaaatagggttgttgaaaattctgtatttaatgagtgaactcagcgactgcagacacaaagagtgtggattctccgaatgattataaaagccttaatagaaataaatgattactaattggaatgggacatgaaagaagataaccttgttacaaagattccaggcaaagaaagaagagatggttccaattacaataatcaaagaggtgattttcttagaatatggctaaggaaacacattttcattcatttgtttcattcatttttttagtgcagtgtttgggaactaacctcagtactagtgaacatatgatgttaattctttagcgaggccaggagcggtggctcacgcctgtaatcccagcactttgggaggccaaggcgggtggatcacctgagatcaggagttccagactagcctggccaacatggtgaaatcccatctctactaaaaatacaaaaaaaaattatccgggtgtggtgacgggcagctgtaatcccagctacttgggaagctgaggcaagagaatcgcttgaacccgagaggtggaggttgcagtgagccgagatcacaccactgcactccagcctgggcgacagagccagactctgtctcaaaaataagtaagtaaataaataaataataaaaataaaaattctttagtgagatgaactgttaatggttgattccataatactgattctcattataaattactgtaacttttagttgtcttaaatattaaacaaaataacaacaatagtgccaacaagtgctgctagtgctgaaaatttcttcagattgttagaggaacagtatttcagtacatatattttgttacaatttcgagaaagaattcaaaacccagaatgggaataacaaagaccttttagagttgtgtttctcaaagaaagaccccaggaatacatgacttgtaaagacctaccagaagaatatcatttagaatggggctttagaatctgcatttttaataagcattctaggggattctgctgtattctagagtttgggaaggactgcctagtagattgtaaggccaaggtagtgattaattgatctaggctagagtaaagctgtggctgaaatatttttctaagttctcccagtgagtctaacagccaggagaaagaacacctgtgcattggcagtgacagcggaggaggtattgtactttgccaaggaagtatgcacagaatcatttttatataggtaataactgtatatctaacaaaactctatttcatttcactcttaaattcagaaaaaaaatacatgtaattcaaaataaacgttatcactggatatggtagcaaaacaacagtgcgtagatatgtgcttatgtttccgtgtgagttctatctatgtgtgtgcttatatatgtgtacacacacatatacacaacacatacagtgagagaaagagaggcagtttataatcttccaacatttttggcttatgtcaacctgtaggttaaaaatctgactttgtgatgccaaagaggaaaggtataggaaggagcagagaaaataactcaaatatggtttacttaggtatgggaggtgaaagattatttgtggcatcattacagctttgtgaaacaattggcaaggttgtgcaaagtaccatcttgatcagtgaagctttttcccttaaggatggattacaagtgtgtaattcaaccttgacttgtagacctccatttcctctctagttatgtgaatgtgcaccatacaatacaaagttctatacctattactttaaaccagtaacgttttattgtacttaataatagtcttaggctatctaggtaatctctgtttataggtgtttacaaagtaatattattttatgtaaactaataaaaacgttggtgctaattgctttacacattgcttggaaaagcaagccatttttgcagttgagtagttgctcagcactattggccaatctatttctatagcttcttgtttttcatctccttcaacaagttcatctgccaatattttgctccccgtgttgctctaatctcaatttctatcttaaaaaaatacaatggtaagggggtactttgcaagttaggcctaagaaggagactgatttcccaaggatgttcacgttgatttattgccttttaaaatactagttgcacaatgaaatgacaaattctgccaatttacatactattcctagtgtcattctttcaatttttcaaccagaattcatatacacagaaaacatgcttttcttgtttcctgagttccttcaagcaaaacataattctataatgagcaattatagcctaacacctgctgctatgaagaggaccttgtcaacatctatctaaattgaagaacaacagcattccttgattttgggaaaatgagcaataaacgaagtccatttcttagcagaaaaactcataggcaatgtattccaaggtagctcacagaataatcaggatttaatagaattagattttttaccatcatttgagagaaagttttgctctgggctaagtattatggttaaggaatccaagaaaaacactaaaattcctggatcccttacaggcaatatttacttaaaataaaaccatccataaaagtccttctctactatagtatctcttcctgtttttcttatgaaacaagaactctgctcaagctgaaaggtaaacaaatcggatagaagcatcatttgagctcaagccatatcaacaatcttgtggatttacattgccaggaaatcttttttcaaaattatgccgggataattacatcaacaaaaatggaggcagaaatcttggtataatatcaaaaagatgggggaagaataggttgctggaaaaagcctgctagcagattgcctagaaagaaaaatgaagccattctaatatgttaaaatctcatctaaacattgaaataaatgattattcacttacagagtaaacagatatgtttaagtgtatttttttacgtagtcacatgtatatatgatgtttctgtgtgcctatgtacacgcacacatacatacacacacttgaacgtcaacttgtacgtattaatagtgcaataaaaaatgttgtcagggatgacttcccctctggcattcccagcactatgactgacagctcttactgcatcaatagaagaattgtatttaaacaaaagttatggtacaattcctaggttgatgcttaatagacagtaaatactacaggaactaccaataagcttccttattaaataaatgtatttattcatttgatcttatgtaaagaacacaaaaggtaaaagaaaaaaattaaaaaagagtattttatttttgtataattaaaaaatctagttccttcttcctggatttgaggtatctatatctgtatctatccatctctctctctctctctctctctctctctctctctatatatatatatatatatatatatatatatatatatgttcatatctatatcaatattgataatgtttctttacttcttaaataaagaattacctaagcatcttttttcaagcgggagaatgaaaacacaattattctaagatggcgaatattgacaagggaatgaaatggtgaaagcaaatctatctagaaaaaagggcccccttagcctgaatgaatagaccagtgaatgaggaaacaaaatgattaaatcaagtcttttgaaagcacagcattattgtgagacatattgtaaagatctgtgcagctattctgcccttcctacatactcattgctctctattatacaaagaaggaacacagagaaaagaacattatacttgaagttagaatacctgggtttgagtgtgactttatcacttactaattatgtgatcttgaacaagttactcaacctctttgtgctcagtttccttttctaaaaaatggacatacaggccggacttggtggctcacacctgtaatcccagcactttgggaggccgaggtggcagatgacttgaggccaggagttcaaaacaagcctggccaacatggtgaaaccccgtttccactaaaaatacaaaaattagccaagtgtggtggcacatgcctgtagtcccagctatctgggaggcagtggttgcagtgagctgagatcacgccacttcactccagcctgggcaacagagtgagactctgtcctgattaaaaaaaaaaaaaaaaaaaaggatatacaaatatccagggctaattggagattcagatttgataatgcataggaaagatcctagtacactataagacaccttacatttataaagtagtataattgtcatccacataccattattattacatcatagtgaaaaaatacaacttacaagagttcagctgagcttaaagaatatattcatttgaagcccaatcattgttgtgtgagcttcttcatattatcttatttcaattattatgcttttatcttagactctaattatatatccagttttacttacgccattaaatgaattttaaaaggagtcacattaaataaaggccctttaaattttttatgagataaagagttgccatagacacactcttttgcatcttacccggtacagtcaaactcaattaactattcagactggcaaagcatcttttacatttttcgtaaagattctaagtgaaaagattgtactatttttcaattaagttatatatctttcaaaaatagctggtagattaaagcaaaggcactgtcacaatcacagattctatttagtgccatttagaggacaaaaatgaagccagctagacttgaaaatgtgttcatagtgatttttcaatgtatcaaaatctactaaatggaacattgaatggcaagtccaaaggcatgtgatggttaagaaatctggtcacaggcccagcgcggtggctcacgcctgtaatcccagcactttgggaggccaaggcaggcggatcacctgaggtcaggagtttaagactagcctggtcagcatagtgaaaccccttctctactaaaaatacaaaaattagccaggtgtggtcgcaggcacctgtaatcctagctactcgggaggctgaggtaggagaatcatttgaacctgggagatggaggttgcagtgagccacgatcgcaccactgcactccagcctgggcgataagagtgaaactctgtttcaaaaaccaaaaacaaacaacgacaaaaaaatctgggcacagataattacacaaggatttcacataacctctctgttattcatttagagatgtctaaaagtaattcctgagaaatttggaatttttattgaacatgtcagaatcttctctaaataacttctgaatcacctgtaaatgcaccattgatttggataatggtggaatctagctgtggaataagttaaaaggtcataaggcctccaagggtgaaatttcagtgaggtaaccagccaggctacggagcagctcggtgagcatttcatcagtttggagtagaatatggggagatgataccttttctcaactcaggtaaaaagaatttgaccaagttctcataccagcttttatgttacacagctgtttattaccatcaatgtttttgaaaactgggcagcataatttccatcatgctatgtccctggttctacttattatttggacctcctgatttactgactaaaactactatttaattatctgtatacaaattcaccggccattttcctttgaggtatccctatttggccagaaaatttagagcaaaagatgttcaattcagaaatttctttttaatgttatttatcagttttaactgatatacataatctttcactttactgtcagagatttataacaaaattatccagtgatatctactgaataaaaaagtaatgtttatcctcagtataccaattgttcagttttggtgcaaggtggtttaatatgtcacagctctaggtaagaatatagtaagaaaccctgagagggacatgtttaattgtaaaactgtgaagcacataaatacatacttactattatcaataataatagttaccatttaaatattgcctgctatatatcacaaagcactaagaggcttaaaatacatttttctctgtcctgtacaattctatttaaaaataggcaaaatttctccactttgtatgtaaggagaatgagtcacaaaaatgttaagcaacttgatcaggcccaactgccaataagtttgaagacaggattcaaacctcagtttgcctctccaaatctcaggaactataccaagccatgagttacatattaaacagctaaggcaggtgggcgtggtggctcatgcctgtaatcccagcactttgggaggctgaggtgggtgggtcacctgaggtcaggagttcgagaccagcctggccaatgtggtgaaaccccgtctctactaaaaacacaaaaaattagccgggcttggtggcgggtgcccgtaatcctagctactcgagaggctgaggcaggagaatcacttgaacctggcaggcggaggttgcagtgagccgagatcgcatcaccgcactccatcctggacaacgagagcaaaactctgtctcaaataaataaataaataaataaataaataaataaataaataaacagctaaggctaacagtcaatattaaaaattataaacactaaagtgtttctctaacttattattttgcatttaacaaaataccattttcccataaagtctattgttaaagcaaactaaatacggcctgagaaggactccgtacttctatatttgagtccctgtggatgaactacaacctatctcaataggtagacaagattgaaaaactaacttaggagtatgggcctgtgacaatcactcagtcttggccaatcccagccgccattcttcagccagttatacactgctgattgttcaaactgtgttcaaataaggcaaacagcgagctgtaaccaatccagctgtttctgcatctcacttccgatttctacatgtcactttacttttttttgtctataaatttattctgaccacaaggcacccctggagtctctctgaatctgctgtaattctgagggctgcctgattcgcaaatcgttcattgctcaattaaactcctttaactttaatttggctcaagtttttcttttaacactatattttttttttttgtcttttagcatcatttttaaaaatagcatttaactcctttgattcagtggttgctatggtttcactatttatcccctccaaaatttaacccccagtgtggcagtattgagaggggaggcctttaagaggcacttggatcatgaaagttctgccctaatggattaatgagttaatggattaatgcattatcatgggaatggcactggtggcttgataagaagagagacctgagctagcaagttagcatacacagccctcctgccatgtgatgccccaggccattgggaccctgtagagagttcccaccagcaagaaggccctcaccagatgtgtccttttgacctgggacttcttgaaatggtctttgcaaaaattataacggtgagaaaatgatggaagtgaaagggatctaatctagccaactcctctcttgcctttagccttcaagctgctcttaattattcctgggcttatgccaagctaactttgggagacatttatagtttaaatgacaatagcccttccccaaaactcaaccgcgtttgtagagctaatgagagaccaccaggctaggaggataggggaaactaaattctgctgcggtgtagacatacaggattgccagccattattccagaggtcacaagacacgcgacttccccaactactcttgcagacaacatcactattgtagaacttaagattggccttttgagatatctgttcagatatatttcatgtctgatgactgatggctccacctgcacctgccaactgctcctgtggccccgcccagaagagactcagtgcacaggaggacccttgcccacagtcctatgattgcaatccctaccagtcagcagcaagcacctattgcgtagctttccacatgcctttccccaaaccgatcttgaaaaccctagcctcagacttcttgaggagactgatttgagtaatagtaaaactctgatcttctgcttagctggtggctgtacatgtataaaactctccattgcaattcccttgtcttgataaatcagctctacctgggcagcaggaaagaagaacctattgtgcagatacattctgagcctccataactgtaagaaataagttcctttttgaaataagtaacctagtttcaggtattctgttttatagcaacagcaaatgaattaataccgagcaaatgaattaataccgtattgggatatcttagatgttttggcattgaagctttgtcttacgaaaatgcattcaggtattgaaaccaccattgcaaaattataactgaaatagtgaaagagatctgatgtaaccaactccctcttgcatctaagccccaggctgtccttgctcattcctgggggtaagctgaaataactttgggaggaacttagtttatagcttatggtttaaaacaaaggcaatgacaacccttccccaaaaccaacctccttcttgcctggggactagactgcctttgtaggactaacaaaatagccaaaagattagaaattacggtttagtagtcatgcagctagagactacaagatactgcttctccccaaattgctcctgggcataaagtcaccattgtaaagcctaagatcagtgcttgagacgttttgcagaccctgcactcgatggatcaactggtaccacacagatcaataaactggctcatctcatcctatgaccccccactcaggaactgactcagggcaagacagctttgactccctatgatttcatctctgatccaaccaatcattacttctgaccactggctgctccccacccaccaaattgtccttaaaaaccctggtccccaaatgctcagggagactgatttgagtaataataaaactccagtctcccatacagcctgctctgcatgaattactctttctctattgcaatttccctgtcttgataaatcaactctgtctagagagtgggcaaggtgaacctgatggcaattgcagtatgtatgtatacccaacatcttgtatgtaattttaagggatgcaaggatcccaaaataaactagaactttagggtgatcgagtgtctggtgtgcctgggggctaagcaggtttgtgggatatgggactttaaattttaaaactgagaaattcctgaaaaacaaaaacaaacaaaaataaaacaagaaaagttggttaccctaaaatgtaacgtttatatagcactttaataaatactatttactagaagctaaggcttttggttatgtatattataaattaggccatagggcaaagcaagaaaatgaaagctttactaggtcaaaactgtgaccgcccaagaggttcaactcgcctgctgcctggacagagccgattcatcaagacaggggaattgcaatagagaaagagtaactccctcagagccagctgtgcgggagaccgaagttttattattactcaaatcagtctccccaagcattcggggagcagagtttttaaggataacttggtgggtggggggaagccagtgagccaggagtgctgactggtcagagatgaaatcacagggagtcggagctgtcttcttgcgctgagtcagttcctgggtggaggccacaagatcagatgagccagtttattgatctgggtggtgccagctgatccatcaagtgcagggtctgcaaaatatctcaagcactgatcttaggagcagtttggtgggggtcagaatcttgttgcctccagctgcatgactcctaaaccataatttctaacactgtggctgatgttagtcctacaaacgcaagtcccaggcaagaaggaattttgctctgggaaagggctgttaccatctttaaactgtaaactaagtttctcccaaagttagttcagcctatgcccaggaatgaacgaagacagcttggaggttagaagcaagatggagtcagttaagttagattgttttcactgtctcagacctaattttgcaaaggtggtttcaatcccttcctttgggttttctaacactttaaccctaaggtataggctataaagatgggaaaaggccgtcgatcgctctggcttcttcctgctgatgggggaagtagcgggaatgggaacgaactccaaggtgagaagagtggaactgctttgcaactgtttgagtggattcatgcaggcctaattgggcttccaaggcttgcgtggcagaaacattattactctcatctatagttttactacagtgtttatgtgaatagcctactataaggtataatgagtcctaggatgagaagtacaattcccaattttaaaagcaaacatttgaaatcattagtttgggaacttctaacccacaaacaatttagaatttagtctaaactgaagaattaacctcaagaatagctaatagtttactatagattttcttttgaagcataatatttctctgttcagtccccatttttattaaaaacaaatcatgatagaaatgatttgcttataaaatgcattttagtcttactgtacttggcctgattatttgcatgaagtgcagcaagaataattatttttcacttaggctttttaaattggctttgatggaactctgttccatgaagaatctcagataagactttttgaaagccgagcccagccatgggtttgtaccctcaaatacctatgagttgaccaaagtcctctcctcttgaggtcccaagataacttggggttcctgggcctgttagaaagtgacattctttacttaccacaggtcaggaaccttgtacagggactctgtgtggacaaggtatgaggccagattccccaacgggctttaaatggctctataagtcaactttgattctttaaaggaagcatgccattccagtcaaagccttggtaaaatgaccaatttctccaatggtgtcctgttacaaaagaaaacagattcttattgcacgtatgcaattaactatactgtcataaattgagaatactcacaaatggtttccaaattctagagaaatcaggtagagagaaacaaatttgctccaaaatttgtcactgagtgtattttactcactcggtaaaagtggcaaatagctctaaagaaataagttatgttgactctgaaaacaaaaggattagcaatgtttaacacatcagtttgccacatttagatgttttttccctctattccaagagcataatttttaaagttatctaagacctgcactcagagtattatatccgattataaactgccttttgaaaaggaccaaagcaagataaaatgtctgtggatgacaaaagtctacagccattattaaagctacaattgactaggaattttggttacttccgtggcacacaacaattttacataacaattataattattaatagtgaaatcatatcagaattatagaagtttcccataatttttggaacacacactaataacatatttatacaaatacagtccaaagaaaaccaaacaccattcactcttctatttgaaagttttccttctattctaacgtcacaatctccagagttattaatcagaaacctgcatttaagaccacctgttacattttacagctggtattaaaaccatttttttttgagacagagtttctctcttgttgcccaggctggagtgcaatggcatgatcttggctcaccgcaacctccgcctcctaggttcaagcgattctcctgcctcggtctcccgagtagctgggattacaggaatgattttgtatttttagtagagatggggtttctccatgttggtcaggctggtcttgaactcccgacctcaggtgatctgcccacctcggcctcctaacgtgctgggattacaggcatgagccaccatgcccggcctataaaaccatcttttaagaggacaaaaatgagacaacaattgcctgtggacgacacaaacattgtagagtagccagagttaaagacacaatcgacaaggaaatttgttacctctgtggcacatagccatttaacataattacaattattactgataacatatactaagtcatattagaattataggagttttacataatctcagaacatatgtcaatcatatatttacacaaatatagcccccaaaaagccaaacaccatttcatatttgacaatgtttcctgtatgatttttatgcaaaatacgccaaatgtcatttttggactttagaggacctaatatctaaaagattaggccagaaagagacataatttataatttgattttggaaagtttgccaaatatcaaaggtttaaaacactggatatcacaaaatagaatcccaggtcaccataagtcattcatttgaccaaaacgataactccaaaatcttaaaagaaaaacctttattctgacagaggagacttagctttccaaacaagacccaataaagacagcatgaggataactgaatttgtctcttctctctccccttttcccctgccatttacccaaaggagaaagccaaaccctttcattatcttttaacgttacaaaaaaatcgtcttcaaaagagaaaaccaaatttcatgttcgcattagtgcatctttaatgctaaagctagtttttaaataaaattttatgtatctatccagttttaattagtttgaccacaaggtgacattctcataaactttttagaacgctttataattttccattaaacagcagatcaattttctaagaagaccctgttatttggacacatgggcccagattctggccccacagtatgactttaatattttaacctatagaaaaagctaaataacctttttcaaatcttagccaacttgtttatacccacagaattttttttttcaggatcaaccctgtataaacccttttcactttgcttaaaccctcagtttcgttccgttactcttttagtttaagacagtctttaaaacctctgaactagacaaaattacattctcttcaacaaaagccatattcctatgccttattatctttcaccaaaaacacattccctacacaccttgtatgtaaaactgtttctccagtaacctcgatttcatgttacaatgttaactcttagcaactttgatttttagtgaaaaacctgataaaaaagctattttaattatatgctagggatggagcctaggacatcagacagaagtgaagataaggtctgactcttttcagcatagctaggggcatagctctccacgtgtccccaggcctcatctataatataatgctccaaagtaaataaattgaacaattttccaaagtcaaggaaacagtttgaccttaaagaatttagcaaatctgatagctgaccttaatttagaccaaatgtctacattttcaagatattttactttaacaataatctttaaaattgtctttattgccaaaagattactaaagtcatgtgaacaaaaagtcatcaaagtttctatttttctgacaaaatatttttttatttaagcacttattttccaagccaattaatcagagctcttttataaacatcacacacacacacacacacacacacacacacacaaaaacacatgtaaatacagacagaagatttggcactgataagactttttatttgccagtttcttaatcagattactggcttcagggtggagcctttggaggaacagggccaggaaagtatgcatttctaaggcttaatcacagctgaaggcaaagacagaactcccaaattaagggcaccattttatactgcaacccaaaaggagagaaatactacgggagaagacagtacagtgcttctaccctacatttcttttcttatttttgtttctttctttctttttaagacggagtctcgctctgtcacccaggctggagtgcagtggtgctatctcagctcactgcaacctccgcctcctgggttcaagggattctcctgccttagcctctcaagtagctgggattacaggcatgtgccaccacgcctggctaatttttgtatttttcttagagacggggtttcaccatgttggccaggctggtctcaaactgctgacctcaagtgatccgccctcctcggcctcccaaagtgcagcctcccaaagtgcttggattacaagcacgagccacggcacccggccataccctgcatttcattgcaaggcaacccaaagtcaatcagcccattttgtaatcagcccgtccttcatgggagtctgatctcccagtggagggtgaggaatgtttccttatcttccgggtgaccaaaagcatgcttctctggatccaagtgtgcaaagagtcaagtatccctgtataactaccattagccatcccttaaagtatatttcctatctagttattacacactaaagctccctcataatgtgaagtaatttctgatatccccaaaactcaaaaccatcagataacacaatgaaaaacagagcagagtctttgattttgagagggatccatctgtttttaattcctggggtttcatgtggaaaacagttttttttttttttccctaaaacgggttctgtggtgcctcctctgtttttcccaatgagtcccaggctaccagaagttatcttagggactcacgtgtgcgttaagagtggcaagacaaaaaaattaaaaaagagaaaaaaatggagaaaaataattcagtcggctgagaagaaaaaactttttccaaaaaaacaagttccaagaagagaaaaacataaaggccttttaaatatatctatagcttgtttatccactcttaattaagctgacttttaaccatagtgctctttaaaaaagaaattcttttagatctcttattacctaattttagccatgccaagtggacaatatttttagcttctgaactttaccaaaggaaacctcctaggtgctgcaaagacatagtaagaagtttctttttacaagatttagaatctccacaaggtagtccagagaaaggaaaattcaagagaggaaatcagaaaagaaacttaataaatggcaaagctacacaaataacaaatcagaaaggaatcattccagaagccaacaattgaacccaggccaccactgtcaaaagacaaagccttagctactgagctatatacagcgttgagaaatttctactgcttttcccagaaggagcctagagaagccagtttcaggcttgcaaggcttttaactgctcaagaaaaatcttaggagtaactatgacatgaaccccaaaattcctgtcctctggatggtagaaaccaaaagaaagtatccccacatggtcacaaggttaagctcttaaggacacaaaacaagacagagaaatttcatagagtattggtttcagggacctgtagcaaagtttgtagctgaccagcctcccaagctgacttgaaaagcagacttatgggtgtcctaacccacgttctatcacgtgatatccctctctccattacataacacagaaagacaaattcttagcacaaactacatcagatgtgctaagattagtctcacaaatccttctttctattaaccaaacccttgcagaggagacaaatagtttactatttaacaatgcagagaaagagagagagagagagagagaccagaaacttgactgataagaatttcttacccttattgctgggatgccaggtttctgggttccctttctctgcagcttccagaagaacggagtggcgtcttacgaccctgcttgcttgtgctatagctgtggggtttaagccactttacaagataaaatcaccctttaccattttatggaaccataaacaagattcttaatttgcaagattctgcccaacgggctgcatggggaactgaattaacattttccaacccagcaaaatacacataacaaaacagacattagtcacctctttccgcacccaatatcagcctggcaaagctcaaaatttttcatcttggtccctgttgtctttgatccacaccaggtggggacggatgacctctgaacggtaattcacaatgaggtctctgggcaagggaaagagcagatagtcaccctgagagacaggactgttgagccttctttagagctcactgaatgtgaccagacaaataaggagggttctctgagttaggcatgctggacttctatcagcaaccccttctgagatccctttcacatatttaaacacatgcaaagacaagagggacagaaggccttccaaatcagatccctaaccaagaagtccaagagtatcccttccaaactatcctcctattttctgtatgagaaacctcctcaaaatcttcctgattgaagagaagtctcccaaaccagtagtcttcctactagttagaaagagcgaactgagacctcccaggagctgaacagacaccccacaatggagtaacagacagagacaccccatgctggatctacagacaccccacaatggggctacagacaccccaccatagggctacagaaccagtcaggagaatgaagcaggcattggcagcacctaggatactcaccaatccagacaccccaaaacggagctacagatagacaccccaccatgaggctacagataccctgtaatagggctacagttaagggacatctccccatgactatttttccattgcaattaagtccacgcacattgggttggaataccccaccagtagacagagtaacagagtcagcccccagtccaagagaattaggcagccacttgggctgccttctggatccatcactgaaagggggccaccaaacaacaggcaggtagccacaggggcaatcctgggtgagcccccaaatttgtaaccacccaaggggttcaccttgcccactgcctagacagagctgactcagcaagacaggggaattgcaatgaagaaagagtaattcatgcagagctggctgtgtgggacactggagttttgttattactcaaatcagcaaatcggtctccccaggcattcggggaacagagtttttaaggataacttggtgggtcgggggaagccagtgagccaggagtgctgactggtcagagatgaaatcacagggagttggagctgtcttcttgcgctgagtcagttcctgggtggaggccacaagatcagatgagccagtttattgatatgggtagtgccagctgatccatcaagtgcagggtctgcaaattatctcaagcactgatcttaggagcagtttggtgggggtcagaatcttgttgcctccagctgcatgactcctaaaccataatttctaatactgtggctgatgttagtcctacagaggcaatctagtccccaggcaagaaggtctgctttgggaaagggctgttatgatgtttgtttaaacgataaactataaattagtggaggttagaagcaagatggagtcagttaagttagatctctttcactgtctcagtcctaattttgcagtggtggtttcaaaacccttatactttattttaccataaacaaatgagcttttagtaatgaattctaatgactgcaatggggtgggggtggtgagttaattgttatcagttgtacaaggttgttttattgtagctcaaatgttggaggaaagggaagctttatggtattatgtttcattaaactaagataggctttcagaattgtacaaaacatttttaaacctatatgtattactgatgatttaagtgagtgtatcagggaaataacttgtttggtgaaaaatggaatatggcctgaaaacataacaacaacttcgtaagttgtccattttctcataaaaataatattgacttacttatatattaaattagtgattcaatttctaaaggccttacaaagatataattcagtattttatggtaattattttctaattagaaatttacttttactatagcactaagtgccaccagtattaattattgttatttccttacaccatacttgttcctagtaaaacaagcttcagccactgttctctataaaatatggtgtcttctagatgggaacaagaatattttacaacacataacctcccatttctagggttgtgacaaaatgcattttatttcaaatggcacgcaatattaaaacaactcagtttatgtttcattaatcaagaattcaaaacaacctcattttgtaaatccataatatgcaaacttggctacagactgtccaatcagattttattctcctttcaagtcagattttccttatcctctttacttacactatcttaccaataggctgtcagatgctagtatgttctgagacattcagtatctcttatcactcaccactcatatactctcagggataaaattctgtagaggcactcaattcgcatagaaacaaccataaaacccagttttgcaaatattaagttagaaaacaattggcatagcattacactatggtaatacttactatgcactcctaaaatttagtgttgatcttatgccatgatgtaaaaacaaaaaaagaaaaaaagttattagtacaaagagaaaaatgtcagatgtgtataatataacctctgatttgactaaaatatgtgataacattcacaagccagaattgagtagagctggcagttcacagaaggcctgaagcctagatgtaatcaatgacatagctgaacttgataaatcaacacatttacataaggaaaatatccctgattatcataggattgaaccttctaaattatctgttgacagtcaatattctgatcattttcttcactgtgaattcagacagactatcattcaaaggtttgctatacagaaagagaaaaataccaaaatgctaaggcacaaatatcaaatctctttcccatgaaaatcagataatttagaattttttaaagttaaccttgaaatgtgactatgtaattaaaaaaaataaaatacttttttgtgataagtcaaaaactaattataaggtagaacatttgctaatatagatttcaaagcaacacctgttaataacatatgttcccattttaaaagtaggtaacagaaattaataactcatagttatataatggggttccaagattttatagtatgaaatgtggtaaaaggtttggtatttattataggatgtgaaaggccccctaaagcacttttaattactcattcatgaattgctaattaatacttccaaactaaaatattaaacactttagaaagactgacccaatattaaaatccaagctgttagattttaaagtgtatgttaaaaaatatttaaactataatatctcttagtgtatatatacacacaaatatctgttttcatatatatgtttatatatattttatatatgtatataatatatatacatagagagcgatagagggagataaaggaagggggttttgtttgtccaatatattttagctgaccacatcattttatgtatttttttatttaaagggccaaggaataaaataagaatgcgaaggtagaatgcagcactttatcctcaattagaaaaatgcagaggaatttaaataattagacttttccacaaatgttatgtttgttgccaggaaacacaggtgcttctaaactcactgctttaggccatgcaaaatttaggagacaggccaattcccctcctctagggaggaaacttgtcagtcaggaaagctcaagagattagcatccaaagccagtttacttctggggctggttaaaagctttcagaggattcctgtgtaattgctaaatattgtaggctaaattaaagttgttatttaaaatgtaaacatcaatagcaactaacatttgattcttgctcttggtataaaaaagcaataaaattattaacaccttggaaagatttgaaaattcattggtagcattaagcaagtaaatatctagcatttagttcatatggcgagaccaattgtgagaacttaaaatacatatttgtgttgatgattctggctactgtttgagaggttatattgccctcttccccaaggatttctcaagaaatgtttatttgatttgtatgatacatttccagctttgttctcagaaatgtcttttctactcacattcattcattctgttcagtacaatactgtgttcattatgctgaggctttaaaattagaaactgtgggggtttgaatcttgtttttgccatgtgatagctgtgtgaccttaggcatatttcacagcctcccagtaaaataaagataaaacagatctttcttcatagaaattatttcaagcattcaatgaggatattaaaatacagaacttagcacatggtgacaaaggaagtactcaataaagttggctcttataattatgatgtagctaccctcaccttcttgattatttctgagttctttttggatctttatgacttctttatattcactagtccctctgcttacgatgaattttttctatgtctattgaaattctagatgtcttcaagatgtcacctcctttacgaaactaatcttagctcccccaaactgaatgcatcattctctgctttgcggcccatagcttcccaaagttacccctatttcagtattcaactcaatatattttattttatttttattgctttttgagatggagtctctgtcactcaggctggagtgcagtggtgaaatctcagctcactgcaacctttacctcccggaggattcaagcaattctcctgtctcagcctccagactagttgtgattacaggcatgcagctaatttttctatttttagtagagacaggggtctcaccatgttgatcaagctggtgtcgaactcctgacttcaaatgatccatccgcctccgcctcccaaagttctgggatcacaggtgtgagccactgcatctggctttgactaaatatattttaattgagttaatatgggatctgccttactgtgaattccatgaaggctgtgaagttatttaattcttctgtactttgtccaaagccatggaagcaccttgcaattggtagaattcaacactgggggaggatcttaaagtaacgaataaatatgtcacaatcgtatgtgcattagagagctatggattctttaattaagaagctgctaagagctactcgggaggctgaggcaggagaatggtgtaaacccgggaggcggagcttgcagtgagccgacatcgcgccactgcactccagcctgggcgacagagcgagactccatctcaaaaaaaagaataaatattaattaccagatgacatattaaatatttttataattctgatattaaaacttataataaaataactttaatgagtggcttggaaattaactgtttaattttcaaagaaatattttgcttttttgaaatgaaataaagacatttcttgttcattaatgactggctctggtaaaagtgacacaaaaaggtgagtgtaacagtgttatggaaaaagatgaaacaggatagtaaaataactgagagatgagcaaatagcctggcccatccagcaacgtagacacatatatctaaatgtgaagttggcgggttcaaacgaatattggcgccatgaggaggctcatgatatctattgctactcaattcatttttttttttttttttttgagacagagtcttgctctgtcacccaggctggagtgcagtgtcacgatctcggctcactgcaacctctgcctcccaggtttaagcacttctcctgcctcagcctcccaagtagctgggactacaggcacgcaccaccacacccagctaatttttctatttttagtagagacggggtttcaccatgttggccaggatggtctcgatctcttgacctcatgatccaccagcctcggcctcccaaagtgttaggattacaggcgtgagccaccgtgcggccctgttgcttctccattcttaactgattgctccagctttacaaaatgataaacccaggaattgtgtctcacgcctataatcccagctacctgggggactgaagtgggagaataacttgagcccaggagttccaggccagcctgggcatcatagtgagacaccatctcaaaaaaaaacagcctgataataaacgtcagtataaaggagatacaatgtgactctcggaaaaatttttaaaaaagttatgaattaaaaaactttgaatcagccttgctaaaagtaaaagaacctaaagtacacaggggtatttgatgaggagcccttagaagtaatcttgttgacctaagcatattacaaaaattgaaattaatgagctaattattattcttcacggtaagatacagaagtagagttcagagaatatttacattttgcctctacaaaaggacgtttaaaaaaaaagaagcctctcgggagaaaaatgaagtagagcaaaggacttactcaagtttaaatttgcagtaactctgtctcttgatttcacaaattaaggagaaggagcaagaagttcccagtacatccaatcatacaactatgaagttccctgacatatttaagtatgtatctataaaaacccctaagatactcaatcatgtgagcacaaagttactgtgtaatcttccatagatgtaaactttaaccacgaagtaagtgatagctacaaagcttgtaaaatatgtttattaaaggaaattgattttttttcagtcaatctagaggaaatggcttcggagatacatggaatttgtttgcttcgactggccatctcacaaagctcattggacttataataatttagttaacaccatattcatgtctccataaaaaccctcataagccacgtatatataccaaaattacatacatgtatttacccacagctacaaatatagtctatgtgagtttcatattaaatgatagtatagaatattattctattctatactatattattatagaatattctattctatattataacatatatattatatataactcgatattatatatatacatttctttaggagatactcatggctgctctgtgtccaactacatttgggagtcacctcttactgaatccttttatatactgggtcacttgcaaaggcttaattgagcatttgactatcatatgccacagaatggatcggacactataaataaaacacaaaagagagtttgtcttttctgggcttcatcttcttaaaaaaatcagctattagacaagcatatgtctaattatatatatcaagcatatgtcatattatatatatcaagttatatatgttaaacatcatacatatactgtaggtagctttttgtggtcacaaagctttactattattatttttatgtacttcttgagaaaaggctatctataacaggataattttaagtaaaaaaagcttaaatctttcagtcaatgttcatatattatcctcataagaacaatttgtgttaggtattcttttctattttaaagtagataaaatataggtacaaacatgttaagtaatttgtctgaggtactagaggtatggcgagaagctgatctcaagccaaaatgtaaaggcctatgtttttctgattctcctattattttggttctatgagagaatgttaaagaaaacataactttttcccaactctcagtccaggactgagaaatctcaaacactaagcatatgagtttgtgagcgaaggtttgcacataaatgtatatactcacatttatgggaatatatgatctgtacttaagccataaactaaatttaaaatttatagtttaaacatgatatttcaaaattctagtaaagcagacacacacttctatttacttttctatttatatttatgtatcttctggtccttttactattttatcaagatacttgaaagcagggatacttaaccaaaagctggtttaggaatggattatgaatggcttatgaatggattgcaggagcatttgaactgctggatttttatgtaaaaggttgtatgtaaaggatattcactgtgtatttttctgaggagtcccacagcttttatcagactgacaaaggatgcatgaactaaacaaattaaaaagcaattaaggtctttataacctctatacatagaaagttctatgttttttctactttttatttccagctggacaaataatgtcttgtaaaagtttagttcactgttttctcccttcaagcccccagtgaagtaggagatgatgttatctatttagtacgggctggagataataaattgtgaacaaagtgaagaatagtcatgaaggctgctttacagaattggaggtaatttggtgtcttttatttactgcagctaaaaggttcttcaaaataagcataatctttgcttcagctacatgtgtttcttccagattttctaatgctcttccacatcactgttttcttggttcaccctttacattttagataaatattccacagtgagaccttcctgatcccaaacctgaattaaataaatactcttacgctctctcatgcacttatttttatttagaaaatttatcataattcttgactacttacatatgcttgtctaatagctgatttttttaagaagatgaagcccagaaaagacaaactctcttttgtgttttatttatagtgtccgatccattctgtggcatatgacagtcaaatgctcaattaagcctttgcaagtgacccagtatataaaaggattcagtatgaggtgactcccaaatgtagttggacacagagcagccatgaatatctcctaaagaaatgttccacaggctgaaattaaggcataatctctagaaaaatgttttttaaaagttgtgctttataatatcacatttatcatggaaatatatctgatcattatgtatcaataacagaaatgtgtgctttactattttctttaggttttgctaaaacttactaccaaatatcctgaaattaatttcactttaaagctaaataaattggtctatatacactaaagtcataagtgaacattttcttttagtagacaattatacaaaaaaattcccttttcctgaaggcatttcttgtctctgaaaataagaattttataattggtcttattttccgttttctttggcttctaggggtcccagaataacatacgaatcaattatttatcttcttagccaacacccttaatccaagcaactgacctcttttgctttgattacattactttcaatacattctcataacctcaccaataaagagctatttgacagatgaatgtgatcaagacaccctttgcttacaattcttcaatagcatactactgcttttaagatagatatccgaactcaggagctttcatttcttgaatgaagaggcttctgtgtagttcctcctcgtcttgtagcaccgtaattttcttttttatttatttattttattttatttatttatttttgagatggagtcttgctctgtcgcccaggctggagtgcagtgtcacgatctcagctcactgcaacctccacctcctgggttcaagcgattctccagcctcagcctcccaagtagctaggattataggtgcccgccaccacgtccggctaattttttgtatttaaagcagagatgaagtttcactatgttggataggctggtctcgaactcctgacctcaggtgatccacccgcctcggcctcccaaagtgttgggattacaggcgtgagccactgtgcccagcctgtaattttcttcttagatatagttaccctggcctttctgttccttcccacaataggagctttgcataagctctttactccaacagaataggcttccttgatattctctttctgaatacagataatgtaaatattactttacgttgtaaatattaacatttctctgactgagtgtacgtcttccccattgacagtaagtttcacaaggataggaaacatgttttcagtttttgtcttgttactgttttgttttctcatcatactccagcaactagcaccttttatgtactgtttttaattaaaatttgaatgagtgaactaaaacatcaggccttaaatctgcatacatatttggctctagtcaattatatatatacttctttattttcactaatttggttgcacattttattatgtctccaaatcattgtgaaagacagtaagcaaaaactgacaaattagtacaatcttggaattcatgtattataaaaggctggttcagattgttttactcaattgtaacatgttttgattgaaacggtgtaaaacaggaaaaaattatctagaaccaaacttttattgcatgttggctatggaaaagtacaaataataactaagacgtaatcaactaggccataatcttgatgagttttcagatttgattatattatatatagatataaaataaaggaattaatattttaataaaatcaatgaaacttcaatatattttacaatagattttaaatactatgttgattttttatgaaagttcagaacatcaaaaagactaatgcaacataaatttgccatgagtttatacgcaccttaaaagaaatgttcgcagattctacttgtatcatgatgggttgcttttgtgacataactattgaaaatgtgtgttttttttttctgcagtacaatcttcacattcagatttaattgtaatcttagccaacttttgctcatagaaggattaatcatatgactttttgtttacacacaatcacctgtagaaagcagttatcattctattcatttcttcattcattcaacaacactgacttttatgctactctatgccaggccctgagtgagttctgggagatactaatatacacttaagttctgccatcaatgaacttacagtcttttgagaaagacaaggcaatagtttcagcatgacttgacaaatcttaagaaaaaagagccagagaaacatagaaagagggatctaaattaggctagaagaaatagcaaggagtagatacagggaggaagggtgtcccagacacagaaatatgcatgtgctatataaaattacataatatatttaagaaagagcaagaaggccgggcgcggtggctcacgcctgtaatcccagcactttgggagtccatggcaggtggatcacctgaggtcaggagttcaagaccagcctggccaacatgatgaaaccccatctctcctaaaaatacaaaaaattagctgggcatcgtggcagtcaccagtaatcccagctactcgggaggctgaggagggagaatcgcttgaacctgggaggtggaagttgcagtgagctgagattgtgccattgcactccaggcagggcgacagagcaagactccatctcaaaaaaaaaaaaaaagaaaaaaaagaaagagcaagaaatttcatgtagttgggatcaagggcattttgaggtaagtaagacagattttaggttaaaggggtagccaagatttttaaattctaaacatatttgaaaggaaaaaatcataatctaattttttattactctttattacaaaaacaaatttggttttaaagatcaataaactacatttttaatacaaagtagtatatacaatatgcatgtaattaccttttgctatttcaagctttgctctgtgtgcatacaaatatatcaatacacatatataatttttaaaatacataaaatcttaatgtgtacaacacacatatgacaacgttttgaatatttaaacaaaagcaaatgacttgctaaattgcaaatatgtacatatggaaaatagatatatttgctcatgcaactgctttttaaaattccattacttctgccaaatcaagcaacactcacacgggtggtataagtacacagaaatagcgaacaacataaatgttagcattcatagatcagccttttatgggaatgtaatttttcatgtacaattcactcaacatattaaaacaatctttttatgtcccttgttatggttttatcagacaagcagaacaatttcaagggaacctaagagtagactatcaatattagtcattgctcatgttgtgtttacaggaagttcactaatttacattcgatttatattaataatcaagagtggaactgcaatgaagtgcaaactttctttttaattctcttttctgtagtgtacaaactcatgtatcagtagctttgggggctattagcactacctccagaatataaacctgtcatattttaaatttgcctcatttcagaagttttgtcttcttatattcaaaggagcatgcttggtatgagtcacagtatcaacttctgcattgaatgttttctaagccatctcaaaatgcatacaaattgttagaaatcaatctcaatttatttatctaacatatttacatgatatccaaaaatgaagacaggatagataatagaaatctaatataaacctgtaagctattttaacaacatcaaatgtatggtgtcccttaagagtgctaaatcaaacactacttcttccagaattttttttttttttttttttttttttttgagatggagtctcgctctgtcacccaggctggagtgcagtggtgcgatctcggctcactgcaacctccgcctcttgggctcacgccattctcctgcctcagcctccagagtagctgggtctacaggcgcctgccaccacgcccggctaactttttgtatttttagtagagacggggtttcaccatgttagccaggatggtctcgatctcctgacctcgtgatccacccaccttggcctcccaaagtgctgggattactggcgtgagccaccgcgcccggccttcttccagaatttttgggagatgtaaaataaagagatgatttaaaaagctctttgtgaatgcatattttaatctttactctggctctggagattttatagaggtaggtaaactaaagttgtgtttctaaataatgtttctgtaagatatatttttaaatctataagttaaaatgtttcagagagataatgcgatctgtttgaagccatgctatattttggagacgactttttttttttttatttttttgagacagagttttgctcttgtcacccaggctggagtgcaatggcaccatcttggctcactgcaacctctgcctcccagattcaaagattctcctgcctcagcctcccaagtagctgggattacaagcatgcaccaccacacctggctaatcgtttgtatttttagtagagatggggtttcaccatgtgggccaggctggtctcgaactcctggcctcaagcgatttactcgcctcagcctcccaaagtgctgggattataggcgcgagccaccgcacctggccaaagggacaatatttctttaggtcaaagggaaagtttacaacaaaccacgtaaccacacaaactgcaagaacaaatatttcccttctgagctgccttagcaaagggtatctgggaatatcaaacagaatgattcataagcaaattataatgtccagaatattcaaattttcaatatcaagtttgtgttttaccagcagaatcaaaattataagaaattatcgagtttggtctcagtatagttctatgtgctataaggatcctccagaatgtaaaaaataatacctgttctcaagaatcttatttaacagttgagagaatgagctggatctgaataaaacacataaactatgattcttagacttttatcacctcagagatatgctaggaaaatactgtattttttaagaatccctttaaaaactttccttaaagcaataacacaagcattctagatggttccacatagaagcagaaaaaaaatacaagaaagaaagctctatataaccaatccctgatttaaaattgtgaaacaatctcaaataggtccagtcccatttcattaccaaacatctacaagtttatgctctgggtttaccatcttttgatatctcctccctaataccagtgaaagggatatggaaatttgttgatacagatgttactgtagaattaatactgacagtgatcagtgaaatttacattggggtggtaattagttattaatgatttaaaatttttacagtgtcacctttactgtcttctaacgatgtgtgtccaaaacagtatttatacatgagactcttttttttttttttttttttttgagacagagtctcactcactctgtcgcccagcctggagggcagtggtgtgatctgggctcactgcaacctctgcctcccaggctcaagcaattctcctgcctcagcctcccaagcagctgagattacaggcactggccaccacgcccggctaatttttgtatttttagtagagacggggtttcatcatgctggccaggctggtctcaaactcctgacctcaggtaattcatcccctcagcctcccaaagtgctgggattacaggtgtgagccaccatgcccagccccaccagtaacattttaagggctcaatagtcacatatggctattggctactatattggtcatgatagatacagaacatttctattgcagaaagttctattagcactatctgagcaatataactttttattgtcactaagaggaacttacctagttatttactctggtctgctagtatgattttacctgtaaatataatacagcatatttggactgcaacacataattgaatctttcccagataggacagaatatatgtatttgttctgttcagaaagattcatcccagtttagcggaagagaaaacgaagcctcaacacctataatagctttttaaatatcacaaaactggtgcttatctatcaaagaatactgacaatgccattaaaattgttgttctctgcgctgtatataaatatactgaataatattggttaatatgggtatgcctaggagcaagttgctaactttctttgaattatagtttctcatggtgtaaaccaattctgcttgaatgggtctgctgtcattggatgtggtataaaaattgtgaggagcttagcataaccataacctagggcaaacccaagcccttctcttaagtagcacggcactaaagacttataacttgagtgcttttcaaaggtgtgtggaggctgtatcctctttactgctccttccctgtgttatatgtaaacaatgtttatttagaaacagaatgcttgttccctggtgctgcaaagaaacagcactcgaacataaatttaactctctcagcaaggtcatttttactttttgcagaaagggtacactcgccagcagttttgccacgagagtacaccgaacaaaggagacagggtcatttataacctgacatgtttactctactgctgtgtccggtttccattggctggaacaggaccacacattctgtatttgtcccgattggctagcaacttagaacttttcaaaagagacaaaggcagaggagaacaaaggaaggaggaagtaacttgtttccacaagttacttgctgagaaaggtaaaaacaccttcaaataaggaagaggaacaggctatgacctaatgcgtgcttggaccagtataagcatgccagggcaaatatttaggctaaattgtgggaactaagaacataaagtacattgatttctttattacggctagtagatatttaagaatgttagcacaggtcgtttaataaattttgcttctaggagacgttactatttattcccatttagatgggtaggaaagtttctttggagagaaacctctactttttacacctgcaagagctcaggttgtaagtggctgtatttctttttcaaaggtcacagctcttgttgggcggtctctcctcagctcctccatttccaggatctagtaattgctccctcacattttaccttttttaggcctagtggtgggttatgtctttctattgtccccagagccaggggccacctgcatcacagtattcattagtttcccttaaccctacccacaactttgaatattgtttcttattgcctctcatagtttacccattttagcatgccgtgtgtttgttttcttgctgatctctgatagataagcatccagagatgatgatatgtctgctattaattaaggatttgttcgtcactccatatgagttaataaaagtccaaaatatgacttaaaattaacaaattttgtatgaacttgtggttgttccatatctatctagaaacatatctctagaatagttctcatttcatgtcgagattaagatatttagtatatagtggcattaactcttcatcttgcccattaaaggcaaaacagattgttttttaattatttcttcaaatggaacttcctttcataaagacaacgtgtactgtaagcattctttactgttttttacagccaagaaaaatcgacatagtttacacacctattgatttgtcataagatgtcaactagagaacaaaaaaaacccaaacagattaatggacaagagtgttaattgcaatgatatataaaaaagccaaaattacataatagctctaacgtaatagctctgacacgcaacataagaagataaagaatgaactatctataggtaatatttaaaaatatatgtagaaaccattaaggcattgttgactcaaggacactggaagagatgctggcccaatccaaacagatgctggtttaaaatgactggactattcttacaaggggcacaccaactcagtatcagttctacagcaaaaccatatgacagaatattatggagcaatgtaagtaatgattaagttttacaatgcaaagttagacaccaaaaaatatctaactttattaaggaaaaaataaactgtttagagaaaggatgttttagctgtgggtggctttccctctgttttaaaattatacttttaaaatttctttaaatatcatgtatttctttgttaaagatggaaacgatgaagccgggcacggtggctcacgcttgtaatcccagcactttgggaggcagaggcaggtggatcacctgaggccaggagttcgagaccagcctgaccaaaatggcgaaaccccatctgtactactaatataaaattagtcagggatggtggcgcatgcctgtcatcccagatactcgggaagctgaggcaggagaatcgcttgaacccaggaggcggagattgcagtgagccaagattgcacagttgccctctagcctgggtgacaagagcaaaactccgtctcaaaaaacaaaaaacaaaaaatgaaaaccatgagtaataaatgaaaatcaattaactcagagtgtattaatggaattatatgtgtatcaagtacaatatttaactaaattataattgtaaaactcctgaatttggatagaatatctcagaaatctacccctaccaattttttcatgttaatatcacctcttctaaaatctcatcagctcctaggaaatgcctagattttaaaaagcaactataacctatggataggatggtccctgtgtggccactaggaagctgctggaagagaaagagagatatagtatattctgtagccatgtgacaagtgtgggaccagaagagcagttagtgaggataattttgcacagcatttgaaattcttacattaaagatactttgttggcaatcgcagcgtttatttgtttatttggttttacatataaataaaaatgcattcctaagcatattaaagaggcacttgtattgttaatgtcctactaaagctaggaaaatacagtttttggatcagatctaaatttaagtctagattctgccacctaggagctgtaaaatcttgtgtaaattactgaaaaatctctctgaaccctattatctatattgatgaatgggcataagagaaactacttcaggccaggtgcggtggctcacgcccataatctcagcactttgggaggccgaggcacgcggatcacctgaggtcaggagttcgagaccagcctggccaacgtatagtgaaaccccgtctctactaaaaaatacagaaattagctgggcgtggtggcacatgcctgtagtcccagctacttgggaagctaaggcaggagaatcgcttgaaccagggaggcggaggttgcagcgggcagagatcgtgccactgcactccagcctgggcaacagagcaagactccatctctcaaaaaaagaaaagaaaagaagaaaaaaaaagaaagaaaaactacttcaaatggcttttgggaagaactaatgtgatagtgtgtgttgaatgcgtagtgcctgatagtgcataattaataaatgtttattcccttttctaaaatgaggaagtaaataatatggtaaatgacattttttctcttttttaaattatattcacaaggtagacttgtttccctctatatcagtaagcttgtttatttttaaactggctcaaggcaattgaagatatttcagataacagaagttaacctttccatcctcttggtattcaaattctttctcctttgataaaactttcaaagaaggttttcaatgtttattccaaatgatttcaagttgacgttataagttcaaattaaagtttgaattcaaatccaaacttcctaaacttttctaagacagtaaaataaccattgttctttaggctcacggacttcatagactgtcacgttttatttatttcaggtttgttgtttgccacaatagacattcttctctttgaaataaaataatatttcctctatttattccttgagataactctaaaatttattcattaaaagaatcgtcctttaagtataattttggaaaaaaagaaacttccaaagaggagatattaccccagaaggctggttttttttgtttttttttttttttaagtattccactttaaaaactcaggtgttacagttcactgagcataatgtattggatttctgggaattaaaggcaatgttatttgacaaagttctaattaactggttgtacagttaaaatttttttcttcaaattttctcatcagataacctctcaaatattttctcatcaaataacttcttagaaatggaggttttattttaaaaaagacagtgttacatttaatgctaggattgaaatcttcctaaagtgggagaataaataataatgatgtatttctctgaatgctttattgattccactacaatttgtccatgtgttaccatgtgttaccatacttggtatattatttcatatccagagtccattcagtcttataagagcttattaaatacatactaatacatatcaaattataaatgaatcagtgggcattctacattttacatcgtatatatgtacatatatatctacatataaatgctcaagcatttagttgttaagtgaacgcttttcattggcaagaaaaacttacttgatgtttaattggttcaggttgcatctcatgcacatacttaaacccgtaaatggcaagtggtatggaagcatataagcgaattaaagtatgattcattttctgtgacaaggggtagtctcatttctttactgaagactactgtgaaattgtgaggatggagatctgagcaaaatcagagttctattggaatggacacaggaatgagcctatctggtaggtgattaaggtatctgttacaacttgatacacaacaagaaatccagtaatattaattggtaagacattcttctagcatcacgatattaaatacgtccagaattcctataaaatctgtacattaagttaatttctttcaaaaattaacttttggttctagagtactttgatgtgtttccataactgacctgtcaggcctctgagcccaagctaagccatcatatcccctgtgacctgcatgtatacgcccagatggcctgaagtaactgaagaatcacaaaagaagtgaaaatggcctgttcctgccttaactgatgacattccaccacaaaagaagtggaaatggcctgttcctgccttaactgatgacattaccttgtgaaattccttctcctggctcatcctggctcaaaaagctcccccactgagcaccttgtgacccccactcctgcccaccagagaacaacccctctttgtaattttcctttacctaccgaaagcttataaaacggccccacccctatctcccttccctgactctcttttcggactcagcccgcctgcacccaggtgattaaaaagctttattgctcacacaaagcctgtttggtggtctcttcacacggacgcgactgaaatgacccattagaaaagcatacttacttatgtcttgcattttttgagctataatttttaaaaaatgtaaactcagaaatgtatggaatcactaaaaaaattatagaaaatgggatctcacagttatgtctttgtaactcatgcacattaaaagcaatcccaaataaaaataatgataaatctagcataataaatcattatttctttaaatatatttttcctaagaacagaacgataactcaaatttaagtgttccaaactgataagtcctcaggggaacactaaaagtgagagtaatttaaaagtagaatatcagtagattttagcaaaagaaaaattgatagtgctcattaggaatttatataatttattgaatcataattacactattgatttacataacagactcctttcacaggtaaactttctcctagagttttgtcatattttacaaattctaaatgagttagcccacttaaatgtttgtttcttaaaattttctagcacagaaaaatatgttaataacgttttaaaataataatgtagtgtgtttcttttgaataaagagactatcatgtagaaactgtcaggcctctgagcccaagctaagccatcatatcccctgtgatctgcacgtacacatccagattgccggttcctgccttaactgatgacattccaccacaaaagaagtgaaaatggcctgttcctgccttaactgatgacattgtcttgtgaaattccttctcctggctcatcctggctcaaaagctcccccactgagtaccttgtgacccccactcctgcctgccagagaacaacccccctttttcctttatctacccaaatcctataaaacggccccacccctatctcccttcgctgactctcttttcggactcagcccacctgcacccaggtgaaataaacagctttatggctcacacaaagcctgtttggtggtctcttcacacggacgcgtatgaaagaaacatttaaccattcttaattcaaacacagacgcccaagtaagaaaagtgaatttataaaattgggtaaaattcacaagctgaattattagttcacaaactgaaatatcagtaataacctaaaatagtgtttattctcaaagacaatgtgaaaactctcattaggcattagaatctacttttcaaactcaaaagtgaatctccttgtaattatcagagctaaatatatgtaaacaaagtaactgatttagttaaagtgattaaacttttttcccattctcccccagttaaaatgaacagtggctaaaaattattatcttaaaggtttatccatagttccaattgcaacattttaaaacgtctattcctacatagaccattggaatagaatagagaagccagaagtgaagccaaatacttaaaaccaatttaccttcaacaaagcatacaaaaacataaattgggcaaaggacagcctattcaataaatggtgctgggaaaatgggacaaccacatgtggaagaatgaaactggatccctatctcctaccatatacaaaaattagctcaaggaggattaaagacttaagtctaagacctgaaaccataaaactcctcaaagaaaacctaggaaaaactctcctggacattggcctaggtaaagaatttatgaccaagacctcaaaagcaaatgcaacaaaaataaaaataaacaaatgggatctaagtaaactaaaaagcttctgcacagcaaaagaaataaccatcaacgtaaacagaaaaccgacagaatggaaaaaaatatttgcaaactgcatctgacaactgaccaatatctacaacctacaaagaactcaagcaaatcagcaagaagaaaacaatctctttaaaaagcttggaaacgacaagaatatacatttctcaaaagaagatatacaaatgatcaacaaatacatgaaaaaatacttaacatcactaatcatcaggggaatgcaaattaaaaccacaatgagatacttccttatcttagccagaatggccattattaaaaagtcaaaaaacaataaacgttggcatggacaagataaaaagagaacacttatatactgctggtggaagtgtaaattaatacctctctggaaaacagtatggagatttctcaaagaactagaagtaggtataccattcaatccacgaatcctaatactgcatatctaccaaaataaaaataagtcactatatgaaaaaggcacctgcatacatatgtttattgcagcacaattcacaatcgcaaagatatagaatccaccttagagtggataaagaaaatgtgagatacacacaccacacacacacacacacacacacacacaccatagaatactactcagccatataaacaatgaaataacgtcttctgcagcaacttggatggaactggaggttattattctaagtgaagtaactcagaaatggaaaatcaaatactgtgtgttctcacttataatgggaactaacttatgagtatgcaaaggcatacagagtgatataagggacttcagagactcagaagtggagggggtgggaatgagggataaaaaactacatattgggtacaacgtacactactcgggtgacggctcaataaaatcccggacttcaccattatacaattcatacacgtaagcaaaaaccacttgaaaccctaaagctattgaagtacaacaaaataaaaaataaaatgtatattccaataagaggaagtttgtagtcttatattcttattgctcagcaaattgtacattaagggcatattgaatattccataaaatatttttcactaatttaattactagtaatcatgtaaagccaaaacataaacattcacagggcttcctggtgatctatttcctcatattttttcctcctcattatttgcctcataatgttttgaacacatccactgtcttcaataagcttcccttacaacatcaaatgtgatttcacctattttcccctattcacttccaacagagattttagttggttatcagatcctgttgtggctgacaggcattagaaatagaaaattatcaagttacttgaggccatgaaattgagggccaaacacagatttccaaaaagcttgctgttttcgatatggttatgtcttcagcccacatcctgtcatgctagggcagttttccatttacagaagcaagtggctgtaaggttttgtggtagtcaggtagatgtcacagcgcaaacaggaattaactcaatacgtataaaagagaaagctttcgaaaagaagtttaaggccgggtgcagtgactcaacgcctgtaatcccagcactttcggaggcagaggtgggcggatcacctgaggtcaggagttcaagaccagcctggccaacatggtgaaaccccgtctctactaaaaatacaaaaattagctggctgtggtggcggatgcctgtaatcccagctactcgggaggctgaggcagaagaatctctttaactcaggaggcggaggttgcagtgagccgagatggcatcattgcactccagcctcggcaacaagagcgaagctctgtcccccccccccccccaacacacacaaaaaaaacagcaacaacaacaaaaaacaaagtttgtgtataatacatgccaagagggtaggaataaaataccatttgctgtcaagatatatttctaaacaagtttattaggaaggcagtagcagatatgaaaaaaaaataggatagggcactggaaataataaatttaaatcagcatttttttaaatttagaaattcataatctccaaccaacagaactaatacttaagtataatttccatggtaatgattatttaaaaccccatattgactatgaatttatagatggtgattccatatgcaaaaaagcaaacttgcatttataatagaaatgagaacaaagcaacagaatgtgtaatatgttgaaggagtcattaactttagtggaggacagtcaagttcctaaagattcatttatttattcattcattcagcaaaaaaatagaattatttagttcaggttataattccagattctttataaattaataatgactttaaatgcatgtgaatttcatagtactgtatatttttttatctaggaatatttttccttaaatgatactattctccgaatttaataaagtaccatttctactgatagattatgacttttaaaaaattggtttataattaaggaaaatatgaataaaaaggacaagctgattgattcattaagaggcaaaattatgctagatattgtatcaacaatatattgttttactaacaataaaactaatgtttccattaactaaaataaataattagaatgactaccatttttgaaatacgtagaacaaataacaaattttagtgcatttaatccctattttaattttattaggtttttttttcagttctactttacatacaagcaaacatgctgagctaagctaatacaaaataatacattttctgttgctgttgtttgtcttctgttttttgagacgaagtatccctctgtcacctgtcacctaggctgtagtgcagtggcatgatcttggctcactgtaacctctgcctctcggtttcaagggattcttttgcctcagcacccccgagtagctgggattaaaggcatgtgccaccaggccggctaatttttgtatttttagtacagacggggtttcactatgttggccaggctggctcaaactcctgatctcaggtgatcggaccgcctcagcctgccaaagtgctgggattacaggcatgatccaccgtgctgggcccagaataacacatttaagaagtgattttggctggccgcggtggctcacccctgtaatcccagccctttgtgaggcccaggagggcggattacctgaggtcaggagtttgagaccagcctggccaacatggtgaaacctcgtctctactacaaatacaaaaaattatccaggcatggtggagggccaactactcatgaggctgaggcaggagaattgcttgaacctgggaggtggaggttgcagtgagccgagatcgcgccgttgcactccagcctgggcaacaagagtgaaactccgtttcggaaaaaaaaaaaaaaagaagaagagagagaagtgatttaaacctaagtctgttcaattttaaaacttgtaatcttaaataaaaattatatttagaattatagtatcaattttattggccagttaaaattttaataaagtagatatatatgcaatttgtactatcagctatagatggcttgtttgaccacattttaatgtgttacatattttcatttagtatagttcatcctggaatattaagttccctagatcaaccactttttaatatatactcatgctattgttttgaaaattagagataactgtttagctttaacataaggctttagactggttaactagtagtgtccattcaggtccctgctggtttctgtttgaaatcaaggccaataataacggtcttaaagaggattattggaaaagttaagatgtgaaccttcttgctcaacaaagaatgcaagcaaaattgtcttaatctagaacagtttgaaaacactatcttagtctattagtgtattttttcagtccggtttgtttcttctgcttctttaaatcatagttgtttttctggatgaacttcattataatctggaaattcacattgacatttctcccagaaagccaaataaagcacacatttagaaagcctaagtacagcatctaaagcttccttgaccattataactgaataacagccgtgtagtgtagtgctaaaaaaaaaaaattattccagttacatggttcagtctcttgagatttacaggtagccaattatggcccacaggccagacaagtgactgatcgttgtctgaaaacaacgacgaagtggggaggtgaaaaagatttacggttttttttccccttacaggtagatgttgtttgaaataatgagatttaaaacgctaatgcagagctttgatctcttctttgatgtttcttgcctgttgtctatatgaaatatagtcagttaaaataaaaagccagagaatagtttctactcactaatgattaataaaaactgcttggcaaatgcaatcttgcacattgacaaatgaaaacagaataggatgcccaacaatggtttaaaaaaaaaaaaggtttttttgtttgtttctttgtttgtttacattgccacagtacactgctctttgttccctgaccctgcaagctctcaccgggtgacttcgactttgcacctacttttctcttttttagaatgccctctctcacatgttaccactagagaaacaatcacgtgtgcttcaaggccaaatcaaaaatttcctcttcagtcctttggactgagagagttatgcccaatttcacagcatatggtacaagcctctgttatttttctgtaccatggtattatatgtacttgcctgtgtctcttctagatatggggtccttaactatttttgtgctatggatccctttggcatctggtgaagcatatggaacacttcccagactgttttcaaatgtgcaaaatgaaaactaaaagcatataaaaaacaaaggaaattaattatattgcaattgtaaaatactgaatataatactattatatgctattaatacattagttataagcataataattaatacaaattaaaagtagtgattagtatactaaccactggtatatattaacatatgatttttcaagatatccaaaacaactaggatttgatataaaaatattggtaataaattcacagatattgctaataccgttctgtgttgcttatcttcataaagggaaagaaatgcaaattttcagttacaggttagtgaaaataaagatgtaatttttttcctatcatggttcatggaccccagattaaggacactgtattttgactgtatggcttcaagggcagagtttttatttgttcatctttgtgtctttagtacagaacagaaccatgggcacaatccaagcctattgaatggtggccgaattgtgtattgaacgttcaaatgtcagttctatcactgcccttatcacatcacaagagagaaatttgatgttcattaaaattaataattttaaaaaacattttaattaaaatatttattataattaaaatctgataaacttgtcaatgggtatgatacgtggcactgtgtatattcttttgcttatacacagatgcttgaaaattaaaattaaaaagctactgcaactaagcactcagcaattgtcatatttttctccacttttccctaagtcaataggcaaccatgaagttgacaatgttgctgataacattgtcatactcaacatcatttcccacaaagcttaaacctctacagaaactcagcagtccctacaacacatccttgaagaatgagaggggtgtcaataatttcagctgctcaaatggaaggctctgacatcaaggaatattaagtggcacattgaagggaattctactattaagtaatgaaggtgaggaaaacaatttctcaatccacggttatttctttgttatactaagaaccgtgcccaatacttatggaacaaaataagcctatcatttggacgtctcctatcagcctgaagcctgatgtcatataaaccaataatctgtgattgaatttttcagctttcagtgttttatttttagcataatatttggtattgccatacgtgacttattattctgttcaatttaatcaaattagagaataaacaaaacgacaaacataatttctcttaatgtgcgtgtgtgtttttcttttttgagacgaagtttcattcttgttgcccaggctcgattcgagtgcgatggcatagtgttggctcactgcaacctctgcctctggggttcaagggattctcctgactcagcctcccaagtaactgggattacaggtgcctgccaccacgcccggctgattttttttctatttttagtagagaccggggtttcaccatgttggccaggctggtctcaaactcctgacctcaagtgattcacctgcctcggcctcccaaagtgctgggattacaggcgtgagccagcatgcttggcttaatgtgttttaatgacataattccaacaaccatataactatattagtacaaaaagcaactacatgaaataaaaatctcaattgtttgccaaatggatacaaataatatatattacatatattatatataacatgcatataataaaatacacagtagtctgcctcttatccatggttttggttacccatgatcaactgcagtccaaaaatagatgagtacagtacaataagatattttgagagatagagaccacattcacataacttttatcacagtatattgttataattgttctaatattagttattgttgttaatctcttatggttcctaatgtatatattaaactttgttatatgtgtatgtatataagaaacataatatatacataaggtttggtattatccacagtttcaggcatccaccaggggtcttagaacacgtatccctacagataaggggagattaattatttctaccattacagaattaaaatgagtctgtgttaatcttcctattcaaaaattatttctaattcagagaaattcaaagagagtctataacgctatgcggtttattgacattaaagacattaatagttaattgcttgaagaagaaaatagactttttcagtaataataacaaatttgcagcataattggaagtgtaccgtcctatccccctttgaactataaaataatattttggtaaaatatggtgaaggatccttacagtgtatcttgatcatagtcctcctgagttataattatctacattattatactaaaattgtggctcttcctcataagatattaatatattcactatatgaaattaactaattgcatagctccaataaaatattaacttattcaactgttaaagtaagaatatcggccaggcgcggtggctcgtgcctgtaatcccagcactttgggaggctgacacaggagaatcacttgaacctgggaggcagaggttgcagtgagccaagactgcgccattgcactccagtttgggcaacagtgagactccatctcaaaaaaataaataaaataaataaagtaaaaatattaattgcatacaaaaaagaaatatgctggataccgtccattgtattagcaatttcaaggctaaacattacttttttttttttttttgagatggaattttgctcttgtcgcccaggctggagtgcagcggctcaatctcggctcactgcgacctctgcctcccaagttcaagagattctcctgcctcagcctccctagtagctggaataacaggcgcccgccaccatgcctggctaattttctttgtatttttagtagagacggggtttcaccatgttggccaggctggtctcaaactcctgacctcaggtgatccgcacgcctcagccgcccaaagtgctgggattacaggcatgagccaccgtgcccggcctcaacattactttcgatctcaagactggaagtgcagtactcaacaaagtaattggggaaaaaaatagtttttgatgtaaaaattttagagttcttgatctttgaatgaagttggtctcccaataaatttcaaacgaataagaaacattagatttgtttccttctggctctagtatataggaaagacatttgcaaagcaggtattccaaaatatgaggcaaaatcatcattcttgcccccccccccaaaaaaatcttctagcaactgttgtaacacagagccattataatgtaattagacagactaagaaccagatgctaaggaagcaaaatataaaagatgaagcatgatattattttggttaatgaatttaattccaaatgttacaggagtgattcatggactttttttttcccaaaagatcagttgtcacatgtacatattgcattttaacatgatgtttatgtaatctaatgagaaaagtaaattctcatgtaatattagatgtttcgaaatggataaactgcagacacttccacgggtagatgaataattcgtcaatagtgataagttaatctttaaacttacccctcaaaatggttaagagttaggttatactataaatgtaatataattccataaaaataaccaagacaaaaaatactttagaaatattgaaaatataatatttgttttcctctaatatcctcaatctggtattattgtgtaattcgaatatatggcaatattattattatttttttttttttttgagacagaatctcacttttttgcccaggctggagtgcagtggcatgttcttggcttactgcagcctccacctcccgggttcaagcgattctcctgtctcagcctcccgagtagctgagattacagatgcccaccaccacgcctggctaaattttgtatttttagtagagacggggtttcaccatgttggccaggctggtctcgaactcctgacctcaggtgatccgcctgcctcagactcccaaagtgctgatattacaggtgtgagccaccaccgtgcccggccagcaaaataattcttaaaattcaacttaaaaattactccaagaaatgtgtaggtaaaagtcaaaacactttagtaaatccacattttgtatttccatttatagtaacctctagtgctcattattttgaagataaaactttcttatacagtaagctttttaaaatgtgagaccaaatcaaacaacaagagcgtaatgaaaaacgatagaaggaaaacaactaaaataagaacctcctagctcagatttattctaaaaagttgaaaataaatataatgtagaagttattattatgaaaacataaataataatattttttcatagatagtaacactagctttactctgaaagtagaatctgtgcttcattaatagtgcctgtgtttaacactttgataactcaccatacagaagtatagcctcagtgttcccagattcctgttcctagggatgaatgatcacattaggaaggtacattcctgttaatttggctaaatctgccagcccaaatcataaagttctcctaaagatgctctatctcaagagcaaacacttaggaaaattgttaatgtttataacaaggcaatcaacatctcatttaaatattcagaaattgatccttccacttcatactttcagttaggatgagcattgaaaacatgtagtaaagcacaacctcagcattcataatgaatatgataagaacaagccttttctcattcatgtttactaccaaacatctgttgaataaactacttaatccttacaaacataaccagattattttcagcaacaatacaaactctatagtgataacagctggtcctttactttcttcagggatatacactccacatatatttcatttcttctcaagttaagtgacaaaaagctaaaatggattgtgatgcagtcaaagccacgaatgacacagttttctaccatagacaaggggataattttttttttctttcaatgtaagccacaagtgtaatggggggatctcctaaacgaaaggcattatggtagggggaggttccttttcaagaccacgcctaaactactgataaatatgataaatatatggttgtaaaagacaacatttctttttttttttttcgagatggagtctcgctctgtggcccaggctggagctcagtggcgtggtctcggctcactgcaagctccgcctcctgggttcacgccattctcctgcctcagcctcctgagtagctgggactacaggcgcccgcaaccacgcccggctaattttttgtatttttagtagatacggggtttgtatcactgtgttagccaggatggtctcgatctcctgacctcgtgatccgccggcctcccaaagtgctgggattacaggcgtgagccactgcgcccggccaaaagaaaacgtttctatgaacacagtattacttatacaatatttaaaaacatattatttgatgctcaatgttttataaacaatgattcaaaaatgcagagctgggtgagcacggcggctcatgcctgtaatcccagcactttgggaggccgaggacagaggatcacctgaggtcagcagttcgagaccagcctggcccacatggtgaaacccatctctactaaaaatacaaaaattggccaggcatggtggcgtgcaccagtaatccctgctattcgggaggctgaggcagaaaaatcgcttgaacccaggaggcagaggttgcagtgagccgagatggtgccactgcactgcagcctgcgagacagagtgaaacccagtctcaaaaaaaccaaaacaacgacaaaaaaccacagggctggccgggcacagtggctcacacctgtaatcccagcactttgggaagctgaggcaggtgggtcacctgagctcgggagtttgagatcagcctgagtgataaggcaaaaccccatctctacaaaaagtacgaaaattagctgggtgtggtggagcgctggtagtcccagctactcgggaggctgaggtgggaggatcacttgaactcaggaggtcaagggttcagtcagccatgatcgaccactgcactccatcctggatgacagagaaaaaaaatgcagagctactgaggtatttacaaagaaatataaagcacagcacgtgctctcaggaaatctataaaaaagttaaaaagttatggaatcaaagttaatccacaggaaataattagcaagcaattatgtcgataactgggtagaaataactatgtggaacaaaagttcatagaaaaaagaggtgtttcaagccgttagagaaagtgttgtggtaactaggacttgaattgaatttttgaagatgggaatgctttagaaccaaaagtcgatggaggaaaaagattccagaaagggggaatcagactagaaaagcaagaataaatgagctggcctgtataggagagagaatattttatgcagagtatatagataaagtaacacagttcaaacccttaaaagtgtatagccagcatagttttctgccaggattcatactgctctcaaatcagaagatactctactagatttaagaattacatagtcaatcagctgaaagccttggaactttcggctacatagtcattaaaaacactactattatagctcaatttcaccaggccacattatatatatatatattttttaacataatgtacacaatacatatatacaattttgccaattaaacttgtttttcaaaaagtaactcattttatctaaagaagttaagctcatcaaagcaaagtggaacagtggtagccagtaactggggatggaaaaaaatggggaaatgctggtcgaaggatagaaactctcagttataagatgagtaagctctggggatctaatgtacagcatgttgactatagttaatagtactctattgttacttgaaatttgctaagagagatcttaagtgttctcatcataaaaaattataatggcaactatgtgaggtgaaggatatattaattaacttgattgtgataatcatttcagaatgtatatgtatcaaatcatcatattgtacaccttgaatatacccaatcgccatttgtcaattatacctcaataaagctgggggaaaaggtacctcatatttattattacattttattgttataacacatatattttatctcatttgacccttgaagtaactgaacctaaaaagcagtatttttagatatgaaaactgaggcccattgaggattaatgattctcaaagccacagggtaagcagtaaagttacaactcctctcatgtgtcctgattacaaatcattacctaacgtctgtaatttccttgcatcatcgagaacctgaaacttttatcataaaaacatttctaggaaatctggtaccatacgctaatcaactatggaaagaaaatccatttttaaaggagtatctcaacttgttgcaatttgcacataaaaatatcctttgtctcatatactacgggacaaaacagaagcagaaacaatgaaataggttcaccattagagatctgactagtcttgaaatgtagacaattcaggtcattagtcatggagtcctaaggggaaaaagcatgcctgattccacactagtaaagccagaagctatctaatttacatcctatacttggctgaggatatcagatgtgttcaggctgaacaagttcaagactcttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtggagacggggtttcaccgtgttagccaggatggtctcgatctcctgacctcgtgatccgcccgcctcggcctcccaaagtgctgggattacaggcgtgagccaccgcgcccggccaagactcttgcttgagtaatttaaagggatgtgacacagtctgaatagtaattggttatttaataatcctgcctgcagtggcaacataagcttgctttactcttaagcactggataggacaaactgtcttactcagtcctaggaaaagaaacgttcatctgaacaaaagatttaaagtcgacctgatgtgaaatcctgaaatacattttgaaaatgaatggattagcgataaaattaatgagaagactaaagtctctgaaatgaaacatttttggcatgtgataacctgatatgctcccctcaaaagtcccttggaattagcctagctatctcagcatagcttttcttacatcatgggtattacattagccaagccaacttgtctatttgtccttgtctcacatcacttttcaccctcaacttttactccatttatgccaatctccttatccacagcaagatgctactttgactttttggcctttctcagcatgcttcttcaccactgtggaagagcttcccagtacaactactactactgccaaccacaacctccatatctgacactaaatccttgcctactaaactgctcattatctttaaaattggcatcactcacttctacttcacacatccactgttcgatatccagccaagcctggactctgactgatcacttcagtgctacatacaaagacaccttagactttacttccttgaactttattgaacatctttacttccttgaacacattgtatatataatagagaaggaggcatataacatgacatatgtcaaaaatatgtcatatatgtcatatatatgttttatatatatatatacacacacacacatataaaatgagctcaaggaagtaaagaattgtaagtattgtcttctttctccaatacctactcctctttgctaaggcatcagatgatgttgtttgtgactcagtaaatcactattatccaccatcaactgaaccatgctgttactctttcccattagtttattccgcaaatacatattaagctactactgcgtgactgacaatatgcatgttagtgtatattcagtggcgatcaaggcagttagaggatggatgaggagagcattccaggaagaggcaatagcagtacagagactggcatttgagaaatggcagcaggtcagtatggctgaaatgcagcaagactgcagaagaaaaggaagaaaaatgaagtgtggttcttggtaaagatattggacgcatcagagcagtaacgaattttaatcagagattgacacaacctggtttatgtttttaaaagctcaacctttaggccatgtagagtatggagtgagtagaaaaggacaaaagcacaagtggcaaagatgagttgggggattattgtagtatctaagggtaaattagactaggatggaaacaaaatatatggatgatatatgtccattttctctgctgttccatgagccttttcttcacttactgggctatctggtccatctcccataaccagtcttctaacccttcctattgatttgcaggttcactaactgtttcctttcgatccacctcctgttcacttttaggtactaaacagagtgaagtcatcccgtgtgagtttcctcaccctccctccctctaacatcttaagtgcctttgccctgttttgtttaagcatgtgaaacaatttctcgctaaccttctgtgttactttagattctccccagacagacactgaggcaaggatttgaggtgcaggtacacagtttatctggcaattgattacaaaaagtacaagtgagaggaaagagaaagtgagattaggaaaggtaaggaggcaatcaaaggtgtgtcaatgagcacattattctggggctcagtcctgctggtgaatctctgagaagctgtgaggaacatgcctcagaattatgcaccagaagatgagatggctgcgtgcttttttcaagtacttccatcccctcgtagttaaaggtcgcttctggtgacattaacacaacccctcatatttctggcttactcctgtttatagcaaagcaagatactgcatggaactcgggtggggaaagaaatatgcggcagaacatcagcaacaacttttacatcttcttatcccttcaggatcttgtttatttctctcctctattgaaacactttttaggccaggcacagtggctcacgcctgtaatcccagcactttgggaggccgaggcaggcggatcacctgaggtcaggagttcaagaccagcctggccaacgtggcgaaaccccgtctctactaaaaatacaaaaattagccaggtgtggtggcgtgtgcctataatcccagctactcgggaggctgaggcaggagaatcgcttgaaacagggaggcggaggttgcagtgagctgagatcgtgccactgcactccagcctgggtgacagagcatgactctctcaaaaaaaaaaaaaaaaaaaaaaaaaaagactttttaaaggggttattattaggggctatatactggatcttataaatcatctagtccaaccctattatgtgaagattagaaaacaaagcattcacattattctatcgatttttggaatgctatttgcaaacttttttctgggcccacttaaatgtataagttttccatattttatgttggttaataagattaaaaccaattttaatatcttgacaccacattgccatttatcaatatgtactacgttttttactggttcctcaaatctcaaatctgtgccagcgtctgttgaatttttataattttgactcaatttatcattcttttttttttttttattgagacggagtcttcctctgtctctcaggctggagtgcagtggcactatcttggctcaccgaaacctccgcctcccaggttcaagtgattctcctgcctcagcctccctagtagctgggactacaggcgcatgccaccatgtctggttaatttttttgtatttttggtagagacggggtttcaccatgttggccaggcaggtctcgacatcctgacctcaagtaatccgcccaccttggcctctcaaaatgttgggattacaggcgtgagccaccacgcctggcctatcattcttttttaatttgcagacttttaagaacaggctaatttgagacacagaaccacaaaagctacttacgttccaaaatgctctgcagaatctctttttgcatgtgctacgtatggcctttgggagaagtacattttttgtagttgttttgtggttttttgaaatgactagaaatatttttagggccctagaaacctccaaggtaagtgtttagaaattgtgcttctaggaatctgtcagtacttttgtaaacattatctgaagcataagcataaacaaatttgaacagcaggctagctcacacagaaatgattttattcattggaatgttctcacatgtggtatactttatttttagtttggtttcatttatgattaataattatgattccaaaggtgcttaaatcagccggccatggtggttcatgcctgtaatctcaacactttgggaggccgagatgggcagatcacttgaggtcaggagttcgagaccagcctggccaacagggtgaaaccccgtctctcctaaaaatataaaaattagtcaggcacggtggtgcatgcctgtaatcccagttactgaggaggctcaggcaggagaattgcttgagcctggaggtggaggttgcagggagccgagattgcaccagtgagctccagcctgggtgacagagtgagactccgtctcaaaaacaaacaaacaaacaaacaaaaaacaaaaaacaaaaatcaaaggtggtgaaataattttgttgaatatttggcactgtctacattaatgcacacactcaatgtatatattttaacttaatttatacttaaaattgtataaaattattttagtcaaagaacctaatgcagcttagccttgattgataatttcattatctttaattacatggcagaatttctcctcattactctttaaccaaaaggctgtggtagaaatcattgatgctcatttttattggaaagtaatttttctagatttcctgataattgagtgataacttcagcactccttagtcacttttcattatgcagacaaaatctgactcttaactttcaaaaaaatatcttaccataatgtattttcaaataacatgagtttaattaaaaagaactttcccacaggttcatgtttaatcttggtttgagtcttgaatatagagtgaagcgaagtacaactttttctgctttggacaaatttagagctgcttgaagagataaaaacaagcggggacctccctctaaaccttccacttctctttctctccctctctcaactgtgttccgaatgctttctctaaaacacagaggctgagttttgactggctggaaaaacatcagtttatttcatgttcttcctttctccagcttccatttcaattccaagtgtggcccaaaagaaaagataggaactgcataaggatgtttcagtcaatgataaactgcatataccgcagtggtcccatttgattataacacgggatttttactgtaccttctaatggttagatatgttttagacattgaaatatttaccattgtgctacagttgcctacagtattcagtacagtcacatgctgtacaggtttgtagccaaacagaaataggatataccatacaacctaggtctgcactacgctataccacgtaggttagtgtaagtacactctgtgacattcacacaacgatgaaattaccttagtatggattgatcagaatgtatccctggtgttaacacataactgtatatatcctgtgtgtgtttgtgtgtcactgaagagatatgattccttcaccatgaggaatcagaaaactgaaaaggtaaacaaattattgtatcctgaaagtctcaaatgagtttttgttctactttcttttgtttttttttgagacagaatctacctctgtcgcccaggctggagtgcaggggtgcgatctcggttcaatgcaacctccgcctcccgggttcaagcaattctcctgcctcagcctcccgagtagctgggatttcaggaacctgccaccacaacctggctaatttttgtatttttaggagagacagggtttcgccatgttggccaggctggtctcaaactcctgacctcaagtgatctgtacacctcagcctcccaaattgctgggattacaggtatgagccaccacgcccggttcaaatgagtttttttttttttttttcagtccaatattaaaacaaacgaaaaccagaatgccttttgttctcacattcaattcataatctaatagctatcagaataaaatgtcatatttattattcatttggaagaaaacaaacagcagtaaaaattgaaataaaaggctgggcgttgtgagtcactcctataatcccaacactttgggaggccgaggtgggcggatcacttgaggacaggagttagagaccagcttggccaacatggtgaaaccctgtctctaataaaaatacaaaaaaattagctgggcgtagtggcgaatgcttatatcccagttacttgggaggctgaggcagaagaattgcttgaacccaggaggcggaggttgcagtgagcccagatagtgccattgcacttcagcctgggcgacagagggagacgctgtctcaaaaaaataaaataaaaataaaaataccctggccaggcacggtggctcacgcctgtaaccccagcactttgggaggccaaggcatgcgaatcacgaggtcaggagttagaaacaagcctggccaacatggtgaaacctcggctctactaaaaatacaaacattagctgggcgtggtggcaggcgcctgtagtcccagctattcgggaggctgacgcaggagaatcacttgaacctgaagggcggaggttgcagtgagccgagatcgtgccactgcactccagcctgggcgaatagagggagactctgtctgaaaaaaaaaaaaaaaaaaaaaaaaaaaaaaaaaaccgaaagaaataaaaataccctgtctttattttcttccttggcaaaattgtctgtaggattcactcatccatttatttaattaatttattgaattcccattacattccaagcaggtattaactactaaggattcaatgatgaaagacaaggtgtataggagacctagtacgtacagccttagtttcttttctcagatttatgctctaaaattccgttaagaatggatttattggctgggtgcggtggctcacgcctgtaatcccagcactttgggaggcagaggcaggtggctcacctgaggtcaggagttcgagaccagcctgaccaacatggagaaactccgtctctcctaaaaatacaaaattagcttggtgtggtggtgcatgcctgtaatcccagctactcgggaggctgaggcaggagaattgcttgaacccaagaggcggaggttgcggtgagcctaaatctcgccattgcactccagcctgggcaacaagagcgaaagtccatctaaaaaaaaaaaaaaaaaaaaaaaaaaggctttatttttatgaagaaaaccataaattaatgtcataaatcttatctatgttaataattatcagttgctttaatcatgaaaacaaaagggaaaaactggcaagtgagccaggctgaaataattcaatataatatttaaagattagaaatatggtacacttgttttctaaagatcagctccatcttatcaaactggaataacatctgaattaaaataatgtgacattgtcatcaaagctctgattattgctgaagcatgtgataggtaggactggccaaaaattaatacattagaaaagttaaataaaaaataatatatatttccttgatatgtttaatcaaaaacatggagaaaataattgtaataaaaatgtctacatccttaaaggcatgttcacccctaactctcagttacgaacatctagattaaatttcattaaaagtcaattatccatattaaacatttaatctaaacgttgcgccccattagaatacatcaaaagcttacattttactaaaagaaagtgactacaatgaatgaacatataactttatagcaaaggttataatttttgaatgtttgactttagttgttaacatttttaaagacgttctaattttttacgaagcattataattaagcaaaatatccagttttttcatagtttcagttttcaaactgtggctttggtaaggtaagttggaaaacatcttagttttaatggcccaaaaggggagactttgatgtatagtatagattcaagtgcttatctcatggatcatgctttcattttactaaaaatataatagactaaaactttacatagggagaaatcgcagagaataagaatcaaaggagtaattaaaaattgagggttttgggaggctgaggcaggagaatcacttgaacatgggaggtggaggttgcagtgacccgagatcgtgccattgcactctagcctgggtgacagagcgagactccgtctcaagaaaaaaaaaaaaaattgaggttttacgtatttgagacctaatgaccaattgtttacttttgtcaacagtaattttactgctaagtaatttaagtaattttactgccagtttcagcaggaatacaatttcctaacatagatatttaatattttattcaatattttaatatattaatctttagtagaatatatgcttcaattttgtgaggatatgtgtttattttcttgtacagtgtaaactaaacaacgcataaagagaacacaggtaactagattaagaacaattattttctgctctttgtattagaacactcattttctgttcttagtaatctagcagcatcagcatctcctaaaaaatctgttaaaaatgcagaggttggggccccacttcagaaggactgaatcagaaactctgggggtggcatccagcaagctgtggtttaaccagccctccaggtgaatctgatgcccactcaaggaagagtgagaaccactgttctaatctatcgtcttccaagagtgtgtgggaagatcaaagaaaaatcaggtcatggggctttgcggagaacaatcaaacaaatacataaatcaaggactctataagcataatttaataaatagacggatgattgtttttaacttatttttcaatttcctccttagtttgtacatgcatttagagataatctcagcaatgtcagcgagcttggtggcatagttcaagctgtgaaggttcaataaataggtcggtaaacattgcaaatcaacacagcttttgatgaaatgtcaggcaagacagggcttagctatattcggctcagcttgaactcataaaccatcaactggcctctgtacttccaggacaatctgatgaataaaatacagatataaaattaaaaaatatatttataaagagattagtaaaacagcaatctgtaagtgagaaatgacaaccacttagtccagaccaaatgagagagaagacttgcaaaagggtaacttttcttacaaatcaagttatgggaaaatttgagatccaaatagacttttaactttggattgtctttattcccaacacacgtttttaatttaatgcggtgtactttatcctaactcttttagctcacccccctgaaaaaaaaactagctgtcttcctaaagatagagaaaacttgtccaagtcagaaactctttggaattttaataaaagtaacataatttagaaattaatatacttcaaatatactgacagtatatattggcaacagaatatatgctaatttagaattttaggatattctataattaaaaaaaaacctgataaatcactacaccttttcactttatttagaagctaccatttaataataagtgtttaacctctaaaatcattctgagatatttcagataattaggcagcctggaattactgtttacaattgtcccagtttgcttcctaataagttgtgcttgtctaaacatgtctaaattactattcacaaggatccttgttatttccgtcttctttgattaaaaacttcttaaaaatgtgagtgtatatgtgtatgtatatatatacacatacacatattcatatgtacatatatgcataaataagcccatatatatatgtgaaacacaggtttttctattgttaatataaaaatccctcattagttttctaatgagtttatgaatgtagtctacgtccttagaaatttaatttgaggtaaaaatattatcgtttatagattaaggtctggatatttttttcttttcttcatactagaaataattttagatacctgaagacaaagttcattaaagccacaacccaaaaagtagaatatgggttccttcttatttcagtgatttgcattatcctataggttattggtgtcaaacccctttcttcccttcctcacaacaaaagccccaatttaacttttatagaaaggcatatggaacaggagtcatccaaatatatcccaggggttgcaaattgaccaaaagagtcacctttagggaagcctgcttctgaatgcttgtggaatttatcattcttctgaatggctgttgcatttatctgcagcttttactcaccagatgagacctcagacatttcaaattctgcggaggctggctacacaccttcataggaaagctttttgctgatttccctgttggtacttttctcttacacattctatggggtatggtaaacctggaggtagagtcatagccaagcacagataaagcaggcacagaatctctgaccagcctcacaaaagcagacaaacacacaatctttttgcacctgtttcttccactccggttgccgtgaatagtgaggtgttctcacagattcagcttcacagacagcattttgcaaacactcccctctcacagcaatggtttcttccctcaccggctcaatctacctgattacgttcccttctaatcagtaacctcagttcctctagaaataactgtgtcgtctgctttatataggatttatctgagtctgaagcagaaactggaaagtagacttagaggagctgattattatgaagacacctgtatttttgtctggtattcacgtgaactcgacagtgcactcatttatgcaaactggtgttagtgaaaaagaaaaagaagcagagaaggaagcaaaaagaagagactggacctataaagttgcgcacctgtgtgatgctaggagaagaaaataactctaaaaacgtccagtgctgctgaaaacacatttgaacttcctatgaaaaccaacagtgcttgacatacaaatatcttcctccagacacacctttaaaaatacattttaaaatctgaaacaatcttaaactcaatctaaaccacaatgcagaagttaattcttaaggcaaatggagattaagaacgaaacttcatccacataaaccctgtgttttaaaaaaagaattaaaaggaataatccgtataacttactcaaatttgtatttgaagttaaaccttgaatcctgcttcttgaaaaaacagaattgtgtcaggcttctgtaatgactgtttacccagagcataagattgaagtggattttcagattaaaaataaaactcttaagtatgtcaatccccatctgatcaaagcatataaactaaatttttccaaggacttcattaacaatataaccaagtagagctgcagttcttggttttctttagagtaagttgttaaaatgattgaagttcatgtaaaagaaatccagagttacagttaaggtttgctttttttttttttttttttttttttttttttagtagatccagtgcccggcaaacagtatgtgctcaacatatgtttatttaatgcgaccaaaagcatacaatataaagtgtcattatcattgccactgatatttttaaaaagccatgttctatacttatttcatttttacgtaagccacaattttacaaggtttcaaacaaaaaaaaaaacccacaccttgttttctttaatataaaatatttggcaattataagcatggaccgtgctggcagtaagttaaaatgtgactgattttttttttctccgttccctactctcaattttcagatgcggaaatttcatttggagagaacaggaggtgttggtgggaaaaatctcattaatcgtaccgtattcccttgtctacaaagagtactgcatccaaattacagaagaactaaagaaaccttgtagcatgagtataattagcagtgctactaagtgaatggaaatggaggttgcctaacttaattaactgtaatcattactcattgtcgtactgcttagaaagattagttgagggtatttcttctgtggtattactttaggcgtttctccttccctcttaaatgtgaaacaattacactataaagaaagaattagcatgccctttcaatcagatagaagcttttccgaacaagtaagttccatgtcctagctcgagggcggcaaaacaggaatgatgggaaaatatttagttgggccaaagttagagaaattaagaaaaaagtagttaattgcagaagttactgacttgaggaggaaaaaaggaaccctatatatgagtttctgtaaagaaattagctcttggccagggaagaaataaataacaaattaagatctaaagggaaaaattaaggataacacagtacaaatacgcagtactgtctgatgaagttgttcacaattgcacaacagtgcaagattccacaatgcaccttcaaggacactgtagctaaggattgctttctgatcatttatccttttagcggaagacacttggcatctgggaacatttgttcttttgaataaaaatcacctcatacctaaaaggaacctttataaatatcagaaaaacaggaatgtctgtgacgacgatcattggtggggcttggcctcattagctctggggccactagtgtaaaaaaaggttcacagggactctcttctagtagggactatatatatatataaatatatatatatatgacggagttttgctcttgttgcccaggttggagtgcaatggcgtgatctcggctcaccgcaacctctgcctcccgggttcaagcgattctcctgcctcagcctccggagcagctgggactaccatgcgccaccacgcccagctaattttgtatttttagtagagacggggtttctccatgttggtcaggctggtctcggactcccgacctcaggtgatccgcctgcctcggcctcccaaagtgctgggattacaggcgtgagccacagcgcctggccgggacttcatatttaatgaggcttttcactgttctaggaattaaactgagtttcaggtattgcattcaagaatcttctcagcaaacctgcaatattggtaatgttattccttaaactcgttttacaggtgaggagattggagctcagagaggtttttcagtcatccaactaaccggaagtgcttaagaatccagctctacctgactccctaaacaagtgtgtgtcaagagttaatgggcatacaaaccacctgggtatcttggtaaaatacgggttctgattcggtaattttaggtgggacctgagattctgcatttccaataagttccctggggctgctgcggctgctgctgctgctggtggtctttggacaacacatcgggtagcgaggcccctagacccgtggttctccaactttgctgatattagaatcccctgaagaacttctttaagaaaaaaacccagtgcccaaactgcacttcatatcaatgaaatcagagtctctagaaatgagactcaagcaattctaatgaacagccaagtttgagaatctgtacccattgacatgttgttatcaaattaggtgctcatcagaatcaactgacgagctcattataaacccagagacctacattcattaaagcagtgataagacttaggcctttgcacatttaggtagaccccccaggtgattctgttatccaacagtttgagaaccactttctagaccatgctccttcaaatcaatcagaccaagccctgcagacaaacttaccattcaggcaaaaaaagttgtgagtaggagcttgttttcatgcatatcctcagggttcatcggtacgataagatatcctccaagctaaaaattcatggggccctcacaccaccacatccccagttacagacatttttttaaacctcttttgtgagtatcagtgtactcattgtatgcttacactgtgtgtgggtttttatgcctgtggttgcgcattaaatctattactttgtcagtacttcaggggaaagcgtatcaatgttgtaagacatttaatatatgcccagggtagctgtataattaaaaggaattgattttgaaaaagaacctaatggtaacctgaaatgaatagacaaaatgatccctaagctcagtaacaactgcagcacaatgtatcaccttaggttaaaacctagttcataaataatcctcaactcctcttcaagggcttgtgaagatgagggtcattttgagaagtgacacattttggcttcaggggagttttagcataactgctgtcagattatatcttcttaaacattttcgttggcagtgaagggaagatgttagatcatgttagaaatgtaactaatggggtcaaaattttacttccttacagctcttaagagcacatacttataggaaactcttttggatatctcccttaatattatctagaattgtccaactattcctttaaatgagcacaactggggccactccttatggctctgggcattgcaccttgcacaaaggtgcttgagtatcatacccacattccccccagccatccctgtgatcctccaataaagcagagtcatactgaaaaaaaagcgtgctttctttcaaaattggctattctgtggatttgggaagtggggaggatgcctctttgtttaattttcaaagagtaccatataagcgggtagcagtcctgcggacaacaaagtgtaataaaaaatgtttgggatttcagttggaaggcattgggaactaattttatgacctagggcaaggtatttaaacttttagcatcaccaggctttccagctataaaatagcttggcaacatgccatagacaatcaacactcaggctccgaagtcaaagcaatttaactagggcttgaattccagttctcctatgtactagctgcataatcttggcacgttatgttatttatatcacatttcgttgtctgtaaaatggggataatatcaattccagcctcctgaggctattgttagtttccactacaaggtgtttaccacagttccagatacagagttagtgctaaataaatagtagctactatttatcaacaacaataataagatgataatcactcacatttcccaaggctttggaggaaattaaatcaaatgatgcatacaaaataagcctttgaagtgaaaaacaccataatgttgttgaagatgggttttcttccttttagtaatatgtttgccatatctttgattttaaagaaatagtagtggttaaaaaaaaagcaagtagtagggccaccaaagatctggctacaataattgttctgagaggttaggctcctgctgagagttggagctaaacctagcacctatatgtagtagtacaaacctaaatatacagtacatcagggaacaacgtagacttcgaatgtacagatttaaaactagaactgcaataacctggtgacatactgaataaattggaagtaagtccattaaatcttgtctctagagttattattcccaataatcacaattttttaaaatgaccatcttgaaaatcatgtttcctggagtcacctccaaatagcagtaagctacccatctcctattacaaaaagaaaaatgagaccagcttgtaaacacattacccaataaagtaccttacagtgcaagcagggaggcattattgctcaatggaagtcaatttaaaataagaggttaccgagctttctcaataagagtaaaggatcccggccataattgttctgcagtaactttggaaaggtgtacttttattcaaaccgtgctatgattttggcttctctcctagggaggaactttcatttcagtaactaagttcatgaaaagccaaactctttgcagctcttcagctggcagcattttttccagtttctacaatctcatcactgtggtgtgtgtctgtttacttaacgattttaagcacaattcttcatgacccatttatttttggatactgttcttttattttgattgcatatctttcccatagggttacagcaagtttgaaggaaaatcaaacaataaaacactcactcaatatcataggggtatttgctttcaaaagtcaaacagaatgaaaatctatctggttggttattttagatgattagtgttaatttttgcacctgatgaccaaaaatcattttagaatttgatataaggaacttttgcacagacatcttacaacatggaatatctctaagtgttaagttttacataaacatgaacatctggaagaacttgagccaacttgggagctattattttacccagcctccttcatcaaacagagctcagaactcccctccgttagctttaagcttttctcaatgaactgagtaatggaatcttgagggacacctttaaatccagcagtagaagcaaaaaccttccccactgataagcaaaagaatatttctggcaacaaaacccatcaactataggcggtatatatctaactcagtcagccttgagttaaacgtgagtcagtaacccctgaaggcaacaacaaaggcttagagtgaaataaaaaagttcgcagacatactgcagaagatccagtctcagagaatgatctgcttaacacttggccctgagattatctgagaatttcctaaaacattcaacacctcacagtgaccacagttaaaaataatgtattataggtttcaaaattgctaaaagaatagattttttaatgttctcgctacaaaaaatgataagttggtgaggtgatagatatgttagtcagctcgactgactctttctacaacatacacatagatcaaaaacatcacgttgtactcggtaaatatgtacaactattatttgtcagttaaaaataaattaattaatttttaaaaaacttcaatacttccaagatctgggaacaactacgtggtaagcccattaatttataactgggactgtaaaccaacagaacgaattcttccacttaaaatcagcctttgattaatggcatacccatatattacgtctcctatatgagaacaacatataatgtatggtatttattatcacaaaatttctagaaataaaataagtccagttcagtaggtataatcctgttctaaatccccatatgtctataatgctgccacatatatcttcttaaaacactagtttcttcatatcacctactgtcattcttataaccccaactcttgataagatagtttccatccattgtccaaacttcatcatctgcctttcatttctcagtacactaagcttgcttctactgaaacgcactattctacaggtttctctctccattagattataagatatttaagaacagaaagactggcttttttacagctttccagtccctagtgcttcctagcactgttcctggaacatagttaccacaaagcaaacatctacttcatgtttcacattgatatataccccactaacgtccaacacgtgttatttaaacaaatactagtctctaaatacttgtacatctgctcaaaaattttataaaatatgctagatcatttctattgtgaaaaattagaagcaaactaaatattcatgaaatagaaatgaaaacaattctggtacatcctattaatatatttatatgcagacataaaaaaatcacattcttatggaatatttaactacgttggaaaaccatatgatatattaagtgaattaagcagcttccaaaactatgtgtatgctaaaatactaaaatgtattattcttagtggttaaaaacctaggctctggagcctgaatgcctggtttagaattccggctccattttataatggcattgtgaccctgaacaagttaatgcatcttgttattgcaccaattttcacatttttaaaatggtctaataacagtacttatattataaaattattttcaggcataaatggataatatttaacatataaggtaattgaaacatgggtatgtaccaagtgctagtaaatattagctatcattatatagttctcaataggaatgtctgtgccaaacaggtaacactggttattcctgaatagcaaaattataggcaactattacctttattgtgtttttctgtattctacttttggcagtgagtgtatattattttgtattataaaaaatcaggctgggtttggtggctcatgcctgtaatcccagcactttggaaggccaaggccagaggggtggttgagcccagaagttcaagaccagcctgagcaacgtagtgagaccttgtctctacaaataatttcttttttaaatcagccaggcgtggtggcacgcacctgtggtctgggagggcaaggctgcagtgagctgtgattaagccaatgcacttcagcctgggtggcagagtgagaccccgtctcaaaaaaaaaaaaaaaaaaaaaaaaaaaaccacaacagattcctcttaaaatatgcaaaatatttactgaacattacattggtaagatgcatacattgttaatggaacaatgctgggatactagatcgaagaagtattgtcatcacgagtagcaagctgcctgtaaaatagtagacattgctctctaaaaatgctgtatttcattagtgctatgggttgaatatttgtgtccctccaaaattcatatgtagaaacataatccccaatgccacagtattaagaggtagggttttaagaaggtgattaggtcatataagcggagccctcatgaatgggattagtgcccttataaaagaggccaagggaacttgtttgcccttccagtatgtgagggtaaaggaagaaggcaccatctgtgaagcagacagaaccctcaccagacaccaaatctgccaacattttgatcttggatttcctgggctgcagaaacagttctgcagcaataaatcttcgttgtttataaattacacagtctatgatatttttattatagcagcccaattgaactaagacaattaggagtaagaagtacgaagaattaccatcattatatatgatgaggttaaaaattatagaaaagatatttctacagaagaatttttaagtggtacaagtttaatacatatataaatatacaagtttagtatatattttatatattcaagtttaaaaactatatacatatatattaaaatttatcacataaaaatacctctctagaaatatcctttctataatttttaacctcatcatttattggaatttgttatggagggagatcgtcccctgctcccttaaagtttatagaaataggtcaatgccatctttcggggctctcccaagactattacaataaaacggggtgtagcaagataaataaaacacacttaggcaaggtgtgctaggatttccaaccactttaacttggcatgaggactattagtctaacagaatgagatactgagaacacatcatcagaagcacttaagcataaatgttctctttttatagtggtggggggaggataacgggagaaatgagtaaaaatgtggtttcagcttctagtttcactaggaacggacaaattagaaagtgaaatgtgagacaatagaaagtttgatgtaattcagcagcactgcaaccatcaattattattttaacatttttggtaaagcttccttttacatccaagaggaccaagtgaaatcaccatgttcttatatttacccatagcatttcttttttatttttatgagctccttcttttgctgaatgaataactatttcagcacactaaaaaattgtgccttagatgtctttctaacagtgcctgtatatggtaagtgctcaataattgcttgataaataatatgcattctgcagttgaggcaaaaaagaaatgacccttttttggaatgaaccaagagagacagaactgaaaaagtgaggaagaagggaaaaataatgaaggaacagaagatgatgtcagataggacttttatcaatgtaagtaaatataattcctatatattaatgaatgtgatatgttacattcatattaaaagtttattaacaaaacatcaccacaatgaatatagttgagattttccttgctatgtgataggtactggtctaagtgatttttatttgttaattttctcatctcagcaatcctatgaggtaggtgctattattaactctatttttcagatgaagaaactaaggaaaaaagagagtcagtgtataaaaaagacagtacaaaaaaagtgtataaaaagagagtcctacagtacagtactgagagaaaatgaaagagttggatttccaacccagaaagtttggctttgagtctgtccttttaaccaaaatattcttaaacatctgtctatattgtctccatttatatatacattaactgaatatttttttaatgtcccttgagttagagaaataatactattacctattcgacaggaagaaacatcagacagaaatgacgtggcctgatcactcagctattatattggcagcaaagcctttctctggcattacttaattcgtattctcacagtaacagcattctcctatccctaattctcagtgctttaggctatttcccaggaacatgctatatagctggaaagagatataagtacaatttgccagcattaataatagggatattgctccttgcatttgctacttctttctgtatctgtctacttttattttttttcttattccctaaacactctatctccattgtgctgattttttgaagatattcatctatcttgattttccttactttttattttctttttgccttggagtagtgtttccttttcttttcatcctggaatagattattgtcatttcaaggcctcccttgtgagtacttttttctcctttttattgccattcttcagcatttttactggtacttataacagttctccttttcttgctggcttctggcgtgggtttgttgctatttcttgttctttgatgtttcgcatatctgattgttccctttctcacccctgctttctgccacgtttacctctttgctattatttgtttcctattttgaaggttgacaactaaggggacagtatcattccttaatgtgtttctccagcttactcatgaaatcagcagcagcctccttcacacataaaaccagtccgggagggcaaagtgactcacgtctgtaatcccagcactccgagaggccgagatgggcggatcacttaaggccaggagtttgagaccaaagcaggcaacataaggagaccccatttctacaaaaatgagccagatgtggtggcgcaactgtagtcctagctactggggaagctgaggtgggaggatcgccggaatacaggagttccaggctgcagtgagttacgatggtgccactgaagcctgggagacagagcgagacccctgatatagtttgaatatttgtccctgccataatctcatattgaaatgtaatccccaatgtttgtttgtttgtttttgagacggaatttcactcttgtcacccaggctggagtgcagtggaacgatctcagctcactgcaacgtctgtctcccaagtagctgagattacaggcacctgccatcacgcccggttaagttattcccagtgttgaaggtggggcctggtgggaggtgatcggagcatgcgggtggatttctcacgagtggtttatcatcatcccattggtgctgtcttcagatggtgagtgtattctcatgagatacggttgcttaaaagtgtttgacacctcccactctctctctcatgttcctgccctggccacatgacatgcttgctcccccttcatttccaccatgattttgagcttcctgaggctttcccagaagccgagaagatgccagcattatgcttcctgtacagcctatggaactttgagccaattactcttttctttaaaaattacctcatcttgcgtatttctttatggcagtgtgagaattgactaatacagccccatcgctaaaaaaaaaaaaaaaaaaaaaaaaaaaatgtctaatcaaagttggaaagtgaacattagggaaatacatattttgtataaataaatcctttggactcccagcttcttcctttgccgatcagctttaagggacagtggttctgtttgacttttgaaaggacagaacaagatccttatatatcacatttctgctatcaatagttaagagtttttgctataaattgaaagtatcatggacacattctttagtcagcagtcactccctgtcattaattaggtgttggaatgatgttctgaaatgctgtttaatttctatgaatttcaagtgggattgcccagcaagtacattgccagcatatgtagtaagtaggtaattttcttttaagattatgaatgttattctcaaaattttaggttgtttttataagggacagtgtacagtttgggcttttgtgttaattggaggttgacaagggaaaaagggatagttttccagcatgctttctaggtttttctaaatagtacaaagatgttcaggaggaagaaaatattgctattttaaatggaatattttcaacgctaacttaagcatatctcagtatttaagcagacatttggatattttcctcatctcagacaataactactatgaccttgaacaaatccctccattttctgattctcagttttctcatctataaaatatgggaattggactaaataactttgtttccatttagctttagcactctatgacttttatccatttacttacacaacactactcctgagaaacatacatttatgcaattatagggataaacacccaggacttcatttaatagattttccttataccaccactgtactgtactggtaacagacactttcccctgtataagtaagctatcctgcagatgctaatggggtgaccccaaaaggccaacagaaattaaagaaacttggcaaaaataaacaaacaaaaaactagccgtggcatacagattaagtatatttacaccaagttatgatttttttagtgacttccccatttaaagttactgatatatacgtgtgtgtatatatatacaatatacaaaatcatcagtatattttcccctagataataattgttaagtataattcaataattgttacatgctgtatacattttaagtgatataaatctttccaacaaacctaaaatgtaagtagttcttttcctaatttccaaaattaagagaggcagagttaagcaacttgcctaaggtcacagtcattaaatagcagcactgagattcgaactcagcaaacagcctggctccagaacccatgcgtctgataactgcttcttataatatggttgtgttcatccattttcttgttcatctattgtgaggttgccagcgtgatttcttcaaaggcctgctggagtcaggaatatgtccctaggtcacagagctcagcaaattttagtagcctaaaacttgactcaattctcctgagcggtactctcagtgtgacctcgctactggtcaaaagttgtaaacgagcagttacatattttttgctgctctcaccaatacatgtcttgctatgtatggccaaacgggttgacttgtgcactcaaaatgcaaaaaagtactataaatatagagtagaaatggaaattggcgacataatatgacaatttaaaaatttaaaatatctgattttcacaagtcttaagagcctcagtgatattcagtatgattggagagtttgaattgtgtaaactttattaagagactagctagaaactcagcagagttttcatggattgcatgacactactttcattttctttgcagtcatcacacaagtaaaattttataggttcaacacactccacatacacctaattgctctctagggtagtaaaacaaccaagcagtgaatccacaaaaacagttcagtgagtttcatttaaaccatgcatacactaccaaaaagtgactcacagcagaggaaattaatttactcgccatgaaaacacaattcttaatgatcccaacactatgacagtacctaaaatttcttgtgtgtatatatttggacacacatgtccacacattttatagcaagaacataaacatttcaaactgaaatgcctaagcaacccttaaagatagcttttgtcaagctaaaatctggtgagaaaatgaaagttaaggcttttattttattttattttttgagatggagtttcactcttgttgcccaggctggagtgcaatggcacaatctccgctcactgcaacctccgcctcccagcttcaagcagttctcctgtctcagcctcccaagtagctgggattacaggcatgtgccaccatgctcggctaattttgcgtttttagtagagaaagggtttcaccatgttgatcaggctggtctggaactcctgacctcaggtgatccacccgccttggcctcccaaagtactgggattacaggcgtgagccgctgtgcccggcgaggcttttaaattggtgaaaatgccaaccattcaatttttactttgaataatcaaaactgaagtgattcaagtagtgattcatcatccagtgtaatctagcacagcaatggagattttgtgtgaaacataccaaaggaaaggtttggggtttttaattgcgtaattgactaattcttgggcacctccttccctcaatcaaagatacatcatctgaatagttcacagcctcccccgaataaatgaaagtgacaggctctgtatttcttaatttgacgcctttcaaagataaggttaatggaattaagtaaccataaagattattgtaaattaaatgttatatccttagatgtctgagttaatttaatgcatttcaataaatatgaggttaggaaacataaaaaggaaaatttatggtactaatttaaatggtacctttccacatctcttgtgcgtgctaaagcataggcttttatgtttgtcaactcacaaatattgttgcagggaagagatagaggtcccaagttgtcttaagaatatggagtcagatgttcagtatgattttaggaacagccatatgaaatgaaatagtcatagctatgaactattgttaaacatcaatagagggagggtacataaatagaagttaatcacaagtaaaataacctaacagtgattatttttattatcataatcatcaaggttagatttacagagcaaaacaaatgcttttctatgttggtttagtgagtattttcacagctatatgtattttagtttttctttaaatttttatatatattaactagaacataatacaaacttcactttggtactagaattacatttttaaaaccattaacgttataatttttacaaggagaaaggtaatgttttgtgatgattattatattattatcaatattggttatctcagaaactgtgcttaatacttttctcatggcaacttatgaagtctttattataatcattttatttataaggcaattgagtcttagaaaggttaaatagatagtataaggtcatccttctagaaaatgagtgacaaatttaaacttagatgatttctaagcttattcttttgactgtagcattatattatgttcctgtagttacagaataatataacacagtgtccaaaaactagaaatcattttattcccttatttagggtagagggctgataataaccttggcaataaaaaaacccaaaacctactgtcacagttcttactgttgatggttttaataaaagaaaaaatgtctttgaggttttccttttatgtggcatctggtatttgcctatatccatgatctatttacagcctctttgaaaattaaccgaatgatattaatagatagtttattttatatagcgttaactcctcctaactttgtacacatttctctgcataatttgaagaataagaacagaggaaatcaacaccgataatacagggaaaaaaatacagttttttttaaaccaagcaagaaaatgcaatctgatgccaaaacaaataaatatgaagaccagagaaaaatctgatatccaaagactggaatctaaagtaaatgatgaagatattagcaatctgttttctgttaaatggattcctctttgttacctttgcacacagcatacattcaaaatattagaaaaaaatcaagtttcaactgtggtttgctttattggcagtaatgtgaaggatcaagtactcaaataatttaagcaaattttagaaataagaggttgtctaatcaaaacacaacctagaaagacaaatattgcatgttctcacgcgtatgtgggagctaaaaaattgatctcatggaggtagaaagtggaatgattgttaccagaggctgggaagggtagtggggagggggtgatgaagaggggcttgtttaatgagtataaaaatacagttagctagtaggaataaaatctagtgttctgtaccacaatagggtgattatagttaacaataattaattgtttatttcaaattaactggaggagtagacttggaatgttcccaacacaaataaatgataaatgtttgaggtaatgaatattccaattatcctgatttgattattacagattgtatgcctgtatcaaaatatcacatgtatttcataaatatgtacaactcttacgtacccacaataattaaaaagaagaaagaaaaacaaaacatatcacaaaggatgacgtagcttgattgatgaattaatagtgtatgcaactaagatgattggagagtgtagaccttagtccatgaaaggaaaatcagagttttcacagagagcaaaagggtgattctatcttgtctttggatttctctccagccatagatgcacacgctcgctacctttgcataccttactccaccatctaaaaagtttccttttatttcaataccactggaaaacccaccatttccttcatcatagattaagaaagagtgggtttttctgaagttccaactaccattgttaatgctttcaatctattgtctattttccatgcttatgattgtgtcagcccatgtgtaactaactcttaccaagttgaaatacgttcactaaggttcttttttgcataagacctgtatagaatagctatatattgaggaattaatagaacagcaatattttttatataccaaccacgagtgagatactatactaggtgttattcatgtatttttgtaacttcacaataatcctccatgttagttatttcatatatgagaaaacatgggaaggctccttccaggctatcttgctaactataaccctagcatttctaaacacaaaatataagaaattcagtgtcttagcactggctattctttccttctggaaggttcttcctcagtttttacatgactggttcctctagacagtcatatctcagctgacatgcctcttcagcaaagattctctttactactgaagctggaataactacccaatcactcactatctcaactcagtttgttctcaatgcaacacttttatctgatatgtttcttgtttatttatcacaagagacataatttctttttcagaaatgtaggctctgtgggagcagggaaatatatataagatccaattacaactcaacaatagataagtcacttccatcattgaagatctgagtttcatcatctataaagtaagataatatttatcagatatggttatcatataatgtatttatataatactaaatatatatatatatacagtaatgtccagtagaaagtatgctgaacaattagtgttctgtaaacaaattttttaagtgcactattctgaaatataccggtctctcatccttctcattttattttttaaaatcattttattgagctataactcacacaccacaaaattcactcttttaaagtgcacaattcagtgatatatagtatattcacatagttatgcaactgtcaccactttcttttttcctttatttatttatttttttgagacagagtctcgctctgtcgccaggctggagtgcagcggcgcgatcttggctcactgcaacctccacctcctgggttcaagcaattctcctgcctcagtctcccgagcagctaggactacaggtgcgcactaccacacccagctcattttttttaaatatatattttcagtagagacgggatttcaccatattggccaggatggtcttgatctcctaacctcgtgatccacctgccttggcctcccaaagtgctgggattacaggtgtgagccactgcgcctggccaactgttaccactttctaatataaaacattttcgtcagcccaaaaaagaaaccccatactcattaggaatcactctcctttctccacgtccccaggccctactaatctactttctgtctgtattgattagactattctgaaaactttatgtaaatctcataatttaaaaaatttcataatttttaaatttttataagttgaaggtattaacaagttaataataaaatacttcttgagagctaactcagggttagctgctttatatttcttcatgctttagctcatataatcattataacagagaaggtagtttctattacaatctttctacagatgcaaatggaaaaactgaggcacacgagtttaagaaactcccagaactacacagttaaaaaatgtagaagtcaggattccaagtcgggcttttcagtcttcctgtgtttgccagctctcacctgagtattgtgttactagtagagggacgtgctcacagtcgcccctatgaggggtatttggatgcagataattaacatcatttcaatccacaaaaataggcttagtcctcaataagtaaggaatcaaggtgagggcactgcagagttagtattttgttgaagacaaattaataaatcttttttttttctttttgagacgagtcttgctctgtcacccaggctgcagtgcagtggctcaatctctgctcactgcaacctccgcctcccaggttcaagcgattctcctgcctcagcctcccgagtagctgggactacaggtgtgtgctactacacctggctaatttttttattttttagtagagacggggtttcaccgtgtcagccaggatggtctcgacatcctgaccttgtgatccacccgcctcagcctcccaaagtgctgggattacaggcgtgaaccaccgccgctggccaataaatcttaaaatattcttcctgctctcctttcttttgtctgttatttccctggatatctactgtgaaatactgtggtctcacatacaaaccaggaaaaatgagagggaggtgcattttatctcaaatacagaacttctaataaaacagagttattttaaatgtatagggggatcaaaatacataaacataaacacttgattatttgatttagcattacattcattgtattcattgcatgcattttattctgctggcaatcaaaattagttccagaagaaggtccggaatggcagttgacacattcccctgctcaatagccctgatatttataattatgatttgaatacattttactgggctagtaaatattaaagcaaatttttagaaatgatgaaaaaattaatttaagcattttttgtctctaaatttacaaacaacaaacatgcaattttctaagtagaataacacacaccagggagtaatgatatttgaaatgactgtgaattttggtctctggatgttcttggcttttggtcatatgattcactacaccttctaggcatgtaattatctcttaacacctcacatcctgtcatacagtatgccattccttaaatgagaattggtctcgagtatcattgtatatttagatcttaataattttaatagaaacatcaaccagtaatttctgaagggcaaaatatataaattttatcacttaaaatatatcttttctttaataaaatctagctcttaaaattctattcagacctagaatgatcctttaagatcatttaactcctataattaaattgcaaaatttgaaatatgttcaacttaaaattcaacctaaaactcaaagctgtattttaaagttcatgttgcacttgttttactgcatctgccagagaatgcaccacaaaatcctttatagatattcagatgaatctctctaccagaaatgaagaaggaacgctgctaatcttgggctttcattggtttgattaccatttcaactctaaatggctgcatgataattagtgggtgtggaataaccagtactgctcaagaagcaattgcctttactgaaaaacaaagtttcgaaagaagcacagtaaactccaagagacaatcaattcaatcttacacacctccctgccatagttttaaatggagcagatgtgctaaaagccagtgagaagacggttgatatttcttagggttcaaacagaaatagaatatccagcacttgactgcccatatttttcacaatgatttattgcagtaaatagtctacacgagcgtcccagttttggactttttccctatcagtcaggtttttaaagccttaaagtagagttaaattaaataaaagaagggatggcttttatctaaaagttagagaacgaacaagaatgttttctagatattaaagtaaattcatttataattatgccatattcagatggatgccattcctatatattaaatgttcatgattttaaaggtcattggacaaaaacactatgaataataaaaaattagaaaaaatgtgaaaaataatgaatggaattatagtagaatctattttaatggatctccatttaactgaatcattagattaaccaaagctctccattccctttgttagatttactatggatcaagatgacctgctgaaaaaccttaactagaaatctctctatgagagataaatcgtatgctttggcggattaaagatagctgcgaatttttttgacatttcttcactggggaggtaaagtctttgtttcctcccttgaatttgggtgggttctgtggctgctctaatagaatgcagtagaatagtggtccccagcctttttggcaccagagactggggtttgatggatgacaattttcccacagactggggttagtgggggggaggtgagggatagtgttaagataattggagactatttcatttatcatgcactttatttctattattattattacattgtattatataataaaataattatgtaactcaccatatcatagaatcagtgggagccctgagctttctttcctgcaactagacggtcccatctgggcatgacgggagacagtgacacatcatcagtcactagattgcctgatactcctcataaagagtatgcgacctagatctctcacatgtgcagttcacaatagggttgtgctcctgagactctaaagccattgctgatctgacaggaggcagggttcaggcagtaatgccagcaatgggaagtggctgtaaatacagatgaagcttcactggctcaccgctcgcctcctgctgtgcagctgggttcctcacaggccacagatgggtaccggtgtgtggcccaggggttggggacccctgcagtgaaagagctgctgttctagtttccagggttaggcctgaagataccagaaacttatattttccgtcttttgtatcattcactctagaaccctgagctcccatgtgataagttcaacaatcctgggtctaccatgctgaagaggccacatgtaggtactagagtcaatagatctagttgacccaagtctccctgtcgtctccaccaaagcaacatacatatgagtacagctgtcttggattctgctgaccagctcatctgccagctgagtatcatttagggatcaagttgataccacatagagtggaaaatcacccagttgacccacgctcaaatttatgacccacaaaatcatgagctataaaaagtgactggtgttttaagctattaagttttataataaattgttactcagcaatagataaccggaacatagcaagaatcaactgtgattgttcccattcctgctcatgtaatgatctaatataattatatactacataatttgatgatacatgactataaaataaagagatgcgttctttctaaaaaatacaaattatcagtaaaaattagctgaagaataaacaggcctttgggagagggatattagaaaagtattgaaggaatcccctcttaaattgttttgcaaatgtctctgtgttctttctctactgcacagaaacgaaaacgtacaagtctctaatctgtaccaccaaatcctcttgattttatgatctcttactactttcttccttataaaagtcagtcttttttttttttttttttttgagagggagtctcactctgttgcccaggctggagtgcagtggcgtgatctcggctcactgcaacctctgccttcagtttcaagggattctcctgcctcagcctcctgagtagctgggattacagatgtgcaccaccacgcccggctaatctttgtatgtttagtagagttggggtttcgccatactggccaggttggtctcgaactcctgacctcaagtgatccgcccgcctcggcctcccaaaaatgctgggattacaggtgggagccactgcgcctggccagtagtcacagtcttaattgctattccttgaacacactctcacctgagagccttttttccactcattcccttaacctggaacaatcttctctatctagttggcttcttgtctcgttctgatttaacctgctcagtgcaactcatcataacacattatttcatgctcttttccaggccctagtattcctgatttcccttgccctactacttttattttccttagcacttatatttcactaacacacaacataacttattaacctaccaaattactgtcctgattgtgggaaatcagagggcttttaccctgaagcaaaccacaacagagaaatagactattttgaagcaaaggtttaggagatcacatatagctgtgaacaaaatatcaacattttaaaactatataccagactattaagaagaactcaaggttttcaacaagggcagtgataaggagaggtcagcatgctttgctatgttatgctgccctctggcatggagttcaaataggccaagataaagccctgttcatgtatttttgaatggataaacaaagtccctctagatgagtacagcgtttgatttttaactacactatttcaggtaacccaaagcttttcttgtctgaaacatataagttatgacaggtctctggaacaagttatatctaaatgccagagtcaggtagtataaggcaaaaagtatacaatccatttttacttgtgtcaccaaacatctcttacattttagctgctgacttttcactaatgtattaatacagaatattatttctgcttttcttcaatttaactaaagaactgaatacttacatttagtatcaaatttctataatgtgtcttcttttaaaaatacaaaggtaattgaaaatatcaattaaatctgaatagtgactagattttatttagatatgagagatacataaatactatggatacaaatcatggtctctgccttcaggcagctgatggccctgtgaacttgtatgtgaagcctgtctggggtcaaattctagctctgccacttacttgtagtcttaggtaagttactcaattttttctgatctccaatttcattgcctataaaagagaattggtgtatatgccaatcatacctcaataaagcagtttaaaaaactgaagaatcaattatttctgaagaaaaaaaagaattggtaagaactcctttatagtgtgtgataattaaataacaaaaactagaacaaagtggcaggcatgggacatggtccatattcagagctaaaagttttctctcactatttttattttcctaaaatgaactagtatttctagaagatacaatgagaataaaaccaattgaaaatattttcttttaataacagtgctttaaaattagcaaaaaaattaaaatagaattttgaaaaaagtaatcaaatagatttgctgtactactgactgtatgttctttacatttgtatgttttgtttttatattttggtatttttaagtattattagtaggtgttcttaaacatttaggtaagatattgtatagttattagctttactattattattattattattattattattagatagagtctccctctgtcgcccaggatggagtgcagtggcccaatcttggctcactgcaacctctgcctcccaggttcaagtgattctcctgcctcagcctcccaggtagctgggattacagggacccaccaccaagactggctaatttttttttgtatttttagtagagaaggggtttcaccttgttggccaggctggtcttgaacccttcacctgaggtaatctgcctgccttggcctcccaaaatgctgggattacaagtgtgagccactgtacctggccagctttcctatttttctaatgagaaaatagtagcttgttgagagccacacacggagtttgtgatttttttttttcttcaggatacgttgcatttatattgtatatcagcgtgtattaaagtgtgtggaagccctctggagatttttacatgtggaatatactagttacttagtaattctctgtaggcaagcggctaagttcacgtatggaaaaccattaagacccattgctgtaacacagacaagggtattactgttaagtgtattgccattttatggtcattccaaacgagaaaagctgcttcattccaggaatcatattgctattataattcaccagaaaacctacactttcttttcctccaatagacagtcacttaaagcaaatgtacaaaaaaaatacaatggaatatggtttaggaattaatgaaaatttaaaaagcagcaatcccattgagaagacagaaggcaatacattttaaaaactgagcattatgcaagggaaaatttgagcagttttcaagttagttctgtattgttctcattaacaaatgtagatggtgcagcatttactacagacaattgattcagacttaaacttttgggctacaaatcatttatatttcagagaaaaaatatgtggtcaaaaacaactaggcagggggcgttggctcacgcctgtaatcccagaactttgggaggccgaggcaggcggatcacctaaggttgggagtttaagaccagcctgaccaacatggagaaaccccgtttctattaaaaatacaaagttagccgggcatggtagtgcattgcctataatcccagctacttgggaggctgaggcaggagaatcacttgaacccaggaggtggaggttgcggagagccgagatcgtgccattgcactccagcctgggcaacaagagtgaaactcggtctcaaaacaaacaaacaaacaaaacaaaacaaaactgtatttcccacaagagacattaaactatttttgtttttatttactaccttaatgttacgcaatttttcaaaagaaaatataatactgtagacgtaaaaaatttaaaacgtatgaaaactgggatatatcaattatcttaaagaagatattcctgaaacatacttaagatttaatattgaaatatataattgtttaaaaatacattaaatattgtttaaagaaattctgttaaaagctgtggggcacattatgaaggcaatactcacttctttacctttgttataaaattaattttgtccatcaatttttcatcaatcaaggtttatctatacacttgaaaattcaaatccacagggatcttgaaaagatagcatagatagtatctttctcttttaatagatgaaaaacaactgcagaaaggcacagacatcttcagtactaaataagtcatacgatacaatatgtctaattgatataaagaaaaggtaatcttgccatactgctccttctggctagtttatttctaaagctatatccaagaatcttgctaaaaatatcagctgtgttattttcattcaatctatttctttcaaacattctatttttcaaaattaggtttcatttgagcatcagtaactttagaagaaaaaataatacttaaaaaggccctggccaggcacggtggctcatgcctgtaatcccagcactttgggaggccgaggcaggcagatcatttgaggtcaggagatggagaccagcctgatcaacacagtgaaaccctgtctctactaaaaatacaaaaattagccaggcgtggtggtgggcgcctgtaatcccagctacttaggaggctgaggcaggagaattgcttgagcccaggaggcggaagttgcagtgagcagagactgcaccattgcactccagcctgggcagcaaaacgagcactaagaaaaaaattagtagtaatatgcaaagtcaggtctcagagctcctgtttcttctaaattaggtgtatctcctcagtctttgaatttagtctaaattggtttataaataataatcctgaatctttctagctccctgccacaaagatggatatttagatatactatggaatatttcactattcctgttttatttctagattaaaaatcaccaaaacaaggagacagaaattttatatcttccctgaccctaatttttccccttgaaatcttgctatcaattatactgacctttggttgtaggcatttctttatatttgtgtttttttgttgctttctacataaactctattcatggggtcttttgccaactcattatattatcctttcagaatatggtcaaaggcaagcccattttacaatccaattgtcatttctaagaggatattggaattactcatgtacagagtaaaaggttattttcctcacctcctacttagcaaaagaaagtgaaaacaatgacattcttatttttagtgatttaattacattttcttatccatgtgattttcttcatctaatttaacaaaattatcagagacatggtctgattacatatcatctttcttattccagaagtacaagacaaaactaaccttgatttctgcttataatcttacattctccccatggattcacacagctctaccctgatttgtggctaataacaacaattttaattttcctattcttttaatgaaagtaatattcctctcttcttctctgaaaaatgaatgcctttatgatttgggagggaaaaattctcctttggtgttttccttccccttcagttgacccacactattaataatcttcacaatatcaatcattgttgcagcttagacatagacaatgtttatgagcctttctctttttttttttttttagacagagtcttgctctgtcacccaggctggagtgcagtggctcaatctcagctcactgcaacctccgcctcccagattcaagcgattctcctgccttggcctcctgagtagctggaactacaggtgcccgccaccacacccagctaatttttgtatttttaatagagatggggtttcaccatgttggccaggctggtcttgaacccctgacctcaggtgatccacctgctttggcctcccaaagtgctgggattgcaggtttgaaccactgcacccagccagcatttcaaatccagatgctaccacaggaggctctgggccttaaagaaatgcagccagctagccgggcatggtggctcgtatctgtactcctagcattttggaaggccaaggtgggaagatcacttgaggcccagagtttgagaccagcctgggcaacacagggagatgccatctctacaaagaaaaaaaaaaaaattaaccaggcatgggctgaaacaggaggatcactttagcccaggagtttgaggcttcagtgagcagatcgcgccaccacgcttcagcccaagtgacagagcaagacctcatttctaaaaaataaataaatgaataagaaagaaatgcagccacttggaaccaatgctgtttttcagatctttgagcctctcagtaacattaattaagaaccctggtaaataaatatactaaccagtggcaagaataattgactgcaaatggctgaatgttttattattttcactttttttaaatagaagtttttgacaacataaaggccttacccaaaggaataacaataataatgaaaagagcaagcatccattgtgttcacaaaatcacagaatacatgtacatcaaatgaaaaataatcctttttcatctctgagaatactccaaaacttgtccatctgagtatcaatggaaaatcttgctctttattaaaaggaattcttcactaatgttcagaaaagctgaggaatgtacttacatcactaccgtcactactagagtatgcactggtggctaaaatgtcctaacaacttcttcagggctcaaatattttagggctttgaattcaaagatgtgtaaaatagagtctctgtcttcaaggactttataacttctatgcatatggtatgtgctagcgtggatgatggaagagttacatttaaccttcaccatggcaggaagatttattgggggagataaaactttgaagataagcaagagagccagattaaaaataaaacaaagtagaaggaggaaagaatgggtgtttcaagaaaaacaaatataatgtgctcttgctgatgggtaattctttgtgtattttcatactcctatttagtgtgtacctatttttctcacagtatatcgaaatacgctattatctgacttcctcgggtaagtctacaagaccaaatatacaataacaaatctattgagaagatacagttatttacatgcacagaaggttattgtgagaaactctatcaaatgcccttgctgatattggcctgacccacaattcaaacgtttgggtaccttcaagaaaatgtctgtattttttaatgtcctttgaaattattactctagtcatgcattatacgataaaagatacacgaaactgatgtccaatggaacagtaagctttgacagttcacattctttatagataataagatgtttaaattcatttccatgatgtattagtttcctgcggctgctgttaaaaagtactacaaactgggtagggtttgtagttgtttgtttgttttttaggagaaacatattgtctcccagttctggtggctagaagttcaaaatcaaagtattagcagggccatgctctcactgaatactctaggagagagtctgttccgtgcctctttcttagcttctggtattgccagcaatccttgccattctttggcttatagacacgtcactcgggatagcctctgtcatatgggattctccctgtgtgtcttctctgtatttcttctcttcttcttataaggacatcagccatgttagattaaaggcccaccccactccaatatgacatcatcttaactaattacatctgcaaagaccccatttgcaaacaaaaaccacatttttgaagttccagaaaagacatgaattttgagggtgcactatctaacccagtgcacgtgataacacaatcctcaatgaactgactgctgtcaatctctcagttttcaactccactactcaactactacatccaacttagcagacaaacaaatatatgtattgaatgagaaacagtccctagctggtaaaagtaaagtagggccaggagcggtggctcacgcctgtaatcccagcactttgggaggctgaggtgggtggatcacctgaggtcagggttggagaccacagccagggtaacatggcaaaaccccatctctactaaaaatacaaaaattagccaggcatggtggcacactcctgtaatcccagctaccctggaggctgaggcgggagaatcgcttaaacccaggaggtggaggttgcagtgagctgagatcgcaccattgcactccagcctgggagacaagagtgaaactccatctcaaaaaaagaaagtaaattagagagaagctaaagagtaaatcaggcaggattttctgggcagagaagtcatgcttggctataaagctatgaaagtacacagaaatcaaacatagctcatttagatcaggcataattattataataaaaagtcattatcttatggcctcacataatattattgcctatatatttctgtgttggtccttcataatacttggatttacatgcagaattgtatatttctgtatcatattttaagtgctctgtaatgcattaattatttgctagcctcatgtaggctgcagctctccagcctttaagttcagtcatatgccaacctgaagaacgtgagggattgagagagtgtcttaaatgagagaagcccatggtggccagcttcatcagaaacctagtgtggctctggttttcgccaggttctttgttccttgtgactcattctctgccttgcattgtctattcggtcccctcaggcctgtcctagctggaaagagctctctttacttcctgatcccatctgttccttgacctcccctctgacccaccactgggcatgctcagaataggaaattgtgccataatagataatcctgacactctgttccatttcttcatgttagttaattaccattcaaggtcttgaggcctacattaactgctcttaaatgtcaggtctatgtacctattgcctgttatggagcaggcctgttggtgaccaaagcagcataacctagcatctgttgctcagatatcatgtcccagcaccccaattaattgccctagccctagtctagccagtcttcagaactgaatcattatttatttggtctgtatgcaaaccaaaccccatttaaatcacattcatctacccaggactctcatttatcaatcaaactgacattttaaatgtcagatgagttatggtatatcctttgagtgatcatgataacattccctcatatttaggagataaactgtctgcatacatcaatatttttaaacaccgaagtaagtgtcaaaggtctgaaaattaatgatgaaatttatcacttcagtattctgcatgcttaaaagataggagtcacacctaccttccaataacctattataagagccaaaaatgatagctaacattcaaaactaggtatctatcatacaacaaatattttacaaatatgttctcatataatattcatatcactgttattttcccacttcatagacacgggcttagtgaaatttcataactttttcaacattacaatgaaaaatatctgagtttctttagtggctttgcctgttgcagacctcaattttttttttattatactttaaattctgggatacatgtgcagaacatgcaggtttgttacataggtatacacatgccatggtggcttgctgcacccatcaactcatcatctacattaggtatttctcctaatgctatccctcccatagcccctcacccaccaacaggccccagtgtgtgatgttctcctccctgtgtccatgtgttctcattgttcaactcccacttatgagtgagaacatgcggtgtttgttttcctgttcctgtgttagtctgatgagaatgatggtttccagcttcatccattttcctgcaaaggacacgaacacatcttttttaatgtctgtgtagtattccatggtgtatatgtgccacattttctttatccagtctatcactgatgggcatttgggttggttctaagtctttgctcttgggaatagtgctgcaataaacatacgtgtacatgtgtctttatagtagaatgatttataatcctttgagtatacacccagtaatgggattgctgggtcaaatggtatttctggttctagatccttgaggaattgcatacctcaatttttaaatacaatttaaaaatacaatcaattttttatctatatcacattcaggcctacctctaaagtatataatgacaatccccgatttacaatggttccacttacaattttttgactttgcaatggtatgaaatagtgcacattcagtagaaaccacacttcaagtatccatacaaccattctggttttcactttaagtacagtactgaataaaagatactcaacactttattataaaatagaatttgagttagataattttgcccaaatataggctaatctcagtgttctgagcatgattaaggtaggctagtctaagctatgatgtttggtagattaggtatattaaatgcattttccacttataatattttcaaattatggtgggtttattggaacataaccccactgtaagtcgagggatatcagcaacgcgtttaggaaaaatagaggcaaagtgtcctctagggtggactcagctaccagggccacagcctagtcagggacactgcctttatgtgaaggaaggctctacttcctcagggcagacacaatcccatgagtgtgtcttggatgcctttacaaagggctggatttcagtcctcacctgccttctcagccgagcatgcctgggcatgcaaaaatagcacaatggtacatggaacccttaaatacattccattaaaacaaatacataaatttggcagggcaaagttaagtttagaaatctattattcaaaagccagcaaggattctaaagtccttcagtgatcttagattgcgatcttttgaagaagacattaaatatgataccaatatctgacctcatttatcaagaggaaatgtgagtttctctcaaagggtgttgagtagatatcacgtgtttactatctctaacaaacagaactcatccagatgataatcttggtcttgcctgccggtgatgatctagtaaacttatagacacagcaattttttagcaaactttaagatagtataacaaaatttaaagacaaaactaaggatttttaaacctttaatcttatttaaattagaactctatcaatgaattaaatgtccaacctaggtgttaaaaattctctattactctaataatttctccccaaattttgtaacatattcgatattccagaactctttgcattgtaatagcattttgttgcatatgaaatacgtcacgtatctcattaaatactaaagcaaaacattaaaggaaaaattactgtcccaatcctacagatgaggaaattgagtctcagtatagttagatcatctttctaagggaaacacaagacttttgtctttatcaattagtcacatcatttatatcatttattgagcactgttctaagggtatcacaaatggcggctgctctttgaatcatcaacagtccaacaaggtgtaggtgctgttattttccccatgtttacagaagaggtagattgaggaacagagaggttaaataatgtgcccaaggtcaaatgctggtagagaataaaaccattttttatgtatgagtgcctatttcttacaaaactctttatatatattatgttcagtattttaggaaccagaaagggtgatattgttattcccattttattattgataaatctgaggttgagaaaggttaaacaacacaaccaaatttacgtgactaatgagtgacaaccaggaatcgagcccaccttttgctgtttctgaaacatgtattcttcccagaataacctttaatctctcaataacagctcatacaattcctccttcccatctcacaaaacctattctgagctctatgtctaccacgaataagcccaagagtagagagaatttatctcacaaggcttaccgtataccccttttcaataatttttatcacattatttctctttctcttccttagtcaacaacatttaatttactcctgaaactatccctacactaatctgaagttgttaaattactaagttattttgcattcatatttccaaaattaattgtccaagttcatctctcaaaatgaaataatttcagctagaaatgagctgtggcacagtaagcctttggatggggaaggtaattataattgttctgtaactctggttatggaacatgatctggacagtgagagttggatagagagggaagccactgggggtagtgtgactaagacactgttttagaatctgaggatatgagttcaagttccacagctaacacctgctagatttgtagtctgtaagttgtcaaatttcaaagaatcttatattcctcttggataagagataggtaataaaaactacctggcacagatggttttgtagaaaatccaataaaataactgtggaaactttgaaattttcaagtgccattaaaatatcaaataccaatttaataattagcttatgatcagatggttagggacgttgactgccgaagtgtatattcaaatcaatgcagtataggctttaaagtagggccaaagcatgaaatgcattttaataagtgtacacttctaggattctttgaaagttgaaaaaataattagtaagaaaatggagatgaagccctacactaggatgatagcacttagaaaaagataaaagtgaatagatgtgtcaaaagcagatttaatgggaattgacaaaaagggacgaatacttgaaactgactcaaagattttgagtctgagggattggaagagtcaggggactgctgttggaagagtgggagcaaatagaatcagaaaacacacgcacacaccaaaaataactggttttggatattttgagagccatagcccaaaagctaaaggctgttctatgttgaattatcaaagccactttctgatctctgtttttatgctgtttttttttttagcattttcaaatttttcctcacttaagattctgtaaaatttttattgcttatatgcttgtgtaagaaattcatatcatgtgattgtgctccaaaaatttttagtaggataatagcattttactgcttctgaaaatgacctgcaatattaggttattatttgttatattaggtctagaaacagcataaactattgactgaagtttgacattttaaaattctctaataaactggaggaaagtccacctctgctggaactctgcagtgcacagaaggcaaataatagactgctatcctgccatggcttcgcttaatacaaatttgtacaatatatacaatttaaaaatgaattcataacatttctattttctcataaaacattgtgatatgtcaggccagtaacaggtgtgaaaatgatggaatcaaatcctcacagaatacgtgtttagaacagacctcttcagtaaagacaacttttaaaaatacaggccgggcacgatggctcaagtctgtaatcccagcactttgcgaggccgaggcaggtggatcacccgagatcaggagttcgagaccagcctggccaacatggtgaaactccttcactactaaaaatacaaaattagccaggcatggtggcacacgactgtagtcccaggtacctgggaggctgaagcaggagaatcgctagaacccaggaggcggaggttgcagtgagccaagatcgtgccacggcactccagcctgggcaacagagtgagactccatctcaaaaatatatatgtgtgtatatatatatatatatatatatgtatatgtgtatatatctatatctatatatatctatatctatctctatctatctatctatctatctatctatctatctatctatataaagttttaggagaaatctgctcagaattgcattcctctcttactcatagtgataaggggacctcgtagctaaaaagtcttgtagaggaggttaaaagttcttcaaagtaaaaacattctcaactccagaaaacaacatgtaagtcaacccactcatgttttctaagccaatatcttagaaagttgttgtcgactcctcatgagcctctgctacccacagccaatctgttgctaaatgttgtgaattcttttttattgtattgtatgtcttaataacttttttcttcacttgccaaaataaaatccatatgctccccccaccctactgcatggttctccagtaaagactatagatattttttctgcttatttatatatattaaatagatttttaggcagtaatttgaaaatcactttgtctctttgaagttgcaaattgttatagaccaaggctggttcatgcccataaaggttgtttaattaatcgaatttgatatgacagagtattacacacaaaatagtggacggaatatgcacaaaacaagtttttcacaaaaggaagtgaaaagcttgtgccaaattcatctgtgtaacactagaaataaatattttaaaaatatatttattgcttagtttaaaaaactggccatttctgagctttaagctatcattggaagctttataatttaaggttttatttgcttgctaaatataattgagctgtttaattgtaatccttagccttggctccttagccaatgtagagcttaataaattcacctttagattatcaataataaacacacatggtaaaatctaatattgcaatagtccgtaaacttccgggcttactttctaaaagcagataagcagagttattgaagaagaatcgtgtgtctatatttcagaggcataaactcattttaggagtcattattactacactactttcacagcatacctttaatcaagtatcagaaataaagtagaacacatcagaaaataagtggtctgataaacaatttaccacacctgaaatgcagactttcatacgaaaaatgttctagcacaacagggtccacaggcaatcaacaatcctgttctcttccttctcctgggctgatctattagcatggctaatagatcattgcactctcctacagaggccagatgggacttctccacattttagttcaagaagatactaccaattaattagagttggcacttgaggttattatttgctttgctttacttactttctttctttttttttttttttgcatacagacttagacagctaaattaaaatcatattgaacatctccttcaatgtgatattaggacatttctagaagtgtttacttgaatctacagattttgagctataagggacttgagtttaggaatttagtttaaatttgactaatagcatacagttttctacctcagcctaataaactcactgactctaataacgaatttgaaaaacaacatgtccttagcatcctgacaaacccacagaactgctgctccttcctcctacatgtcagtttgggtttcagcattgcatgacaaaaatctcaattttctttatgtgttagaagttcataattggaagtgtgaataaaagttaggggaaaaatgacttaaacttcagcagcaggaaaagataatctttactgtctgtctagttttagagcatccaataaacaagaacatccatcaaaaaactctttggtggcttgaggaaatgtggggagtgcctgagtatcacgctatccttcttgtgaaatttttgataatacatgtctgtagtaagcatgattcacaactactaactaaacaatttataattccaacaatttcacctaaattacacaaaggtgtgtttagaatatacaggagaatagccagtatgaaaaaaaaatgtattcagagaaaagacaaataatacagctcaggaatgaaatgtttctcagctaagggacgacataggatcacaattcatctaggtgttttttccgcagttgctttcagtacatatttatacaaacagaataaaagaagtaccggaaccaaataagtagtaaacaaagggggaaagagatgattttgtaatttgcaatgctcatgcacagaaaataaaatgaaggtaataatagcacaaaaagaaaacaagggcatcaagtaagaagaggaagaaaaccaaaacacacaggacaagaagatggggcgttaaaacaagaaagctctagtggagcagtaactgagggtaaaggaagcgctcaagttttgatgtataggaagcaaagaaggtaactgaaagtgattaatgatgttgttttggcaacagaatagcagattaagggcagctttctgaactgattggaaaggatgctgaaggaaggaaaggtgctcagtgtgggaaatcggagatggcaggatacaggaataccaggtcaagagagatctcagtagtatattctaggttttaaaaatataatggagtgattgatatagtttgaatagtagtctaggtgttagaaagagacacagctcaacaatatcattatcaatcatcgctgagaaaaggcaaggagtaatttaacaggaatgataagcttacaggaaattaaaagtgaaataagatatatgagaagatgtgagaaagagattaacaggattattctttaaaacatggaagtaaatttgagaaacatttccctttccaaataataacccatactcctaaattaaaacttatggtgaaataatacagcataattttctacatacggatgaattcagtaaggagaaatacttaatttctaaaaattgaaagcgcaaagttattttgatttgtaaagttttcagatcattcctctattaaatatcagtgactttgcttactactttttcaggtattgtggggtatgtatccaaaaaagtgtgttacctgatttatgcatttatgtctattttttaaaacattgcttcttctataatttctcctcttttcagttcaaagaatggaatatagtacaaagaaccttgaacaaaaagtcatggctgggctttatttctgaatatacatacatacatatatatatatatattttttttcctcagtgtgtattcattgagtgaacctgaatgagcaatttaaactgtctaggctgccttttactagtctatcaaataaaagaattaatttctactcaaataaatctagaaggctattaatgggatattaacacatttaaaagtggtttaaagtagaaaaagcaccatcgatatgtatcactgatttgcttatccattccacaaattaagtacctactatggagcagatgctgtcttggttctgggacaacatctatgaatgacactgaaattgtccctgctctcctatcaggtattggtattattaaaaactgacgtatttctgagaagtcctgagaattctttctgtagtaggaaacaacgcttgaataatttctgctgaagaacatttaaaaacacagttatgaaagctggagagtaatccatattattgtccttgcttcagtttatttttctattattattttatgcattttaatgtaggtaaactaacttcgatttaggtctttctccttgcacaacttcagggaggactgttcatagaaaatataacttgaaaattgtgtccttgaatttatgcactaaatggtactgcttcaattcatattcttcaattcgactagtaattatttgaaagatttttaactttataatttgaaagaaattagacttatatgaaagttgtaaaaattgaatcacatattctaatgtatccttcacccagaatttttttttactttatcttaaatataatttctttttgtctgtattttagagtcaatttctactcagaagaacaagtatataatgaaaaactgttaaaatgtgtgtggcacagaaaaatgattttgagagtaaaatttgagcatggaaaagaagatgacttaattattatacttatattcaagcacaggggaccaaaacttttctcagcaatatcatgtctagtaagagcagaggaaaatatttaaaagcttggacttgggaacaaaatggcccagagtcacttcccatttaccacttatgaatggtgtggccttcagcatgctcattaaccattcagtgtcttaaattccttttgtgtaaagagagaatattatcatatatcatttaaaggctttataaagattaaatgagttaatatttataaagtgcttagaaaaaatgtctggcacacagtaagcaccattaatggcttgataaaagtaatttgacaggtaaaccaacagtactctttctattttgtaatgtcaaatcatggctacacttgaactctgagataaagagaaagattgggggcatggaagagtagcgtgtgtgcatgtgtgtgtgtgtttgtgtgtgtatatatttaggtgttaaaatattttatctaagtttccggaattctgcacaatgtagtgaaaataaattggtaaaatcacgtttatggctaatggcaaacatatatacaatgtggcaattactacttccaaaatactgttgaacaaaaaataactttatttactatatattttttaacatcagaaagaacgttgggatcctacaatcctgccaaatcttgattttgacctgtatggtactgggattgtagtgggctcaggtgttttgttgacctttgaattattagccatactctgaaagttgtttttgaaattgaatcctagaaaattcctgatatatagcttttttttttggaaacttgcattcagataatttgggtcttaaggtaaatttaaattaaccctatttagaaacgtcaaggaaattaaacatattaaagagatattggtgtcacatatacaaacttacatgagccttctttaggaagaagcaagcagataaatgaaaattagaaaaatattgaattgtggaaaacagaagtcaatgaggaaaaattagtaattaatccaatgtagtactctgagatcattgatgatgccttgagtgtggctgggagtctacctggattattgatggggagaaacttttgatgatcatggtgacaaaatcaaagagaaggcgtaaaggatacagttatattccctaagtaaaataattagttataggattgagaatttcaaataaaaagcaatatggaaaagcatttattatataaataatgtaactggcacagaacacagaaatgcatgaataccttttgaatttccaaataagatagattcctgtcaactctctagaagataggtttttttttttgcctctattgattctcttgcatgcacaaagtctttgaatatttgtttctcatcagatttaccttcaacagtattggggcctcccaattacatacatgcttttattacccaatgaacagaaaaaaaacaattactgttcatattatttcaactgaaatcaagcttgttaaaagctctctcacaattgttaattttgtacatttgcaaaaatcaatagctagaaaatttactagacacgaaggcctctgaaacaatacaaatgatctttatgccctagggctacgaatttattgataaggttaacaatccttgggtaatgacagcttacttctcttctgaatctagcctaaagattccattaaatatatttctaaacaacaaaaatgtctagatgagagtctaaactgatttcaagtgtttgcttcaaaggacaaaacaaagacagatgctcccttccagccaatgacttagacaatccatattaaagattgaagtcaatggtcatgatatactaggttgggcaatctggcttgaatgtgacattgactggtttaaattttgaattaatgttctctcaaaatatttcatccatcagttggtttatttacacttattatttaccaattactgacataggtgctaacacgcagcaaaaacttttaaaattatttttatttgtatttcctttttaattttaatagctttaggggtggaagtggttttttgttacacaaatgagttctatagtggtgaattctgagattttagtgcacctgtcacctgagtagggtatattgtacctaatgtgtccttttttttaatcgctagcccccctcctagaactcttgatgaattcagaatctagggagaaagtcagaaaagcaatcagtcaatacaacgtagtacagaggaaaatctctgaatagacttccatgtaaccaatgcctactcaggtaatttgccagattaacaaacaccctgcatttcctctgaaaagtacattggctaatgcccagggcaagatggatacttttaggtaatactcaactcattggtagacccatgaggttccgctctcacaagttgagtatgtacccaaaagctaacttagttaagccagttataattatttctagagttacataaagattatcaactgaaaaatgtaagctccatgaagacgagggctttgccgttcccaagtaactagactagatcctgcttaatatttattaagtcatacacttacaaaagtttttatttatgcaaaatctaaactgaatgttgtagaaataatcaataaatatggttgcaaaatgattcaaatgcttggacagacaaatgtaaaattttattaaaaataataaaaatctttagttctatgtgcagattgcttcacaaatatcttttatttctcattcagatataaagaaactgaaactggaaattatagattatgctagctatgagcaatagaactatgatccaagccacataggtaattttaatttgtctgatacccacattacaaataatgagaaatgggtaaaactaacatccatactgtattttacttaaccaaacagatcccaaatactatcatttcaagatgcaacgcatataaaattattattgagatctttcatattatttttacactaagtcttcaaagtccagtgtgtattttacatttatagtacctctcaattcatgctagctacattccaatggccatagatggcaagtggctaccatactgaacttcacagaagtagacaatatggatgtgatttctgtaagaaagagaaaaataatctcactctaatctgtgaatttctgtagtaggtatgaggtctaggtctatgtacattttgtttgtccgtggatgtcccattgatccagcaccatttgttgaaaacactactcttcctccactgaatttattttgaaactttgtcaaaaatatgttgggcatatttgtgtgggtatgtttctagactctttattctgttcaattgatctatgtgtcaatccttctgacaatataacacaatatttgttgctgtggttatgtggtaagttttaaaatcagatcttattgtataagcttaacaacatataatgttactgaaatgataacttccgcaatttggggaaaaaacagaccagatggattgaacactcctttaaactctctctctctctctcagctgtctaaatgcctcaaaatggaaattcaacagatgagagcttcttattgagaaaggggaagtagtaggggaatctattttgaccacctctctggtttgaaacctctgggggtttaagagaaaaggagattcaagatatggcttagttttaatgttaatgctacagtagtacagctgggacttgtcctacatttactgagaactctaatttacgaaaactagatcctagcattctgaaagcagatttgagacctctaaagctatttcttttacagttttttccacctttggttgcagtctattgtattgtcctgattctttttttcacctactcgtaggttattcttaatcacttgaaaccaaccacttctatgtatatgatttttgcttcctttccctcacagatccctcaggtaccctgtcttatacttttagtaagtcatgcaaaataattgagaaatgagtcatgcaatttattgctgcattttattaaattagagtggtcagatatacttttactgacagagatttggattttactgtcttgaaacagaagagagagcaaaatggttaagaaggtgatgagaaaatgaactgacatttatgtaacagtgccttattattaatatatggttggtgctgtgctttgtaccctttgagagatattttgtgatccaattttatagataggaaaaggatctctaaatattcagttttggaactgatgttctaaccaggtcatcctgacttgaaatttcaggtgattccctcatgatgcatcttgacgcaaacaaaaaatgtactgaatatattattataaatgtgagtaactagaaatgcatgggaaagaagaggggaggaaaagagtaaaaaggaatattaaacaaatgtattcaacaaacctttattgagtgtctattatatggctggctatgttctaggtactggaggtgtggtaacttgggaaaattttatcaacatatattacagtattttctgcataattccccgccatacttttatttcctttgaattcacagtttccattaaaataatttattgagttaaagcctagagcatagacaggcaacttttcaaagataccataataagtttttatttactcatttttgaaagaaggactagtcggatgctggccataaacaggggctaaaatttcatccatctttccatttccaccaatggaggtgtagagttggaatgaagttaagtgaccaagcctcttgagagaggtgaaggatatctcaggaataagcaactagcaatagacaaaggagaaaaatcgaaacagagagaaagaatggtttggtgctgtccattccccatccaccactgccaaacatacttatacaactctggccactcaaactacctaaatgagccaacttcgatgaaacaaacactattgggagagattacactcccgtggtagtatcaagtaagatcttatcctgcatttaacgcattaggaggaagtatttcaccagtagctaaaaacattattagtctaacattaactgtttctatcaaagggatttaattacatgacattaaatagtacatgcacttgtatacaaataatttttttctcaacaaacacagaaataataaaatagagaaaagactaggtgacagatcacatatattgagatacttgccataaggtgagactgatcaacatccttcttcaaggatataaaaatttaatttacttagagggggtttcagaaattactaattgaaagatcttacttaacaaattttttttacattagaaaaaatcagaacttggtaaatcctcttgtcactattagtaaaatcatgttaattagtccaaaactttattttaatacactatacttttcctatacttcagtcaataacttagtttgtggttttctataattcaatcactaagtttatttagagaaaaatatccttaacttggagtccagtggtctttgaatctcccaaaatatatgcaatattttatgtccatgtgtgtacatcatgagtatagattctgtgtttacatttgatttttaaaaagatgcatgtttaccctccaactaaaatcatgaatttattgttttaaatttaaaagttggctaaatggctatgatgtttatgtattttcatcaaaagggtagttgtttgtgttttatttccaagtctatgacttgatgtacaaaaacctttacactgtatcgtaccccaaaaacatactcagattcaaaagagagaggaattagaaaaataatgaaacatttcagtttaaagtgtcttctcagtggcagattcagtgtattcattacttttgcttcttctagagattaaagtgcataatctaatctcataaacagtagctaattcatactggcttaatagaagatcagttgggaataataagctcgatagaatgataacattattactggaattctcagaagaacttggcaatccaagcaagatggataagactaataaaatattacaaagaataaagaaaaagttaagatttatgatagtctatttatgtttctgttattatgtcatataataccataagctgaggtaattcatatagtctgttctacatttcaccaaatcacccttaataactaaacgataaagtgataaaattcaagacactgtgttggaaaataagagggcagagggaaaggagcttggatgataaataataattaactccaatttctaaggaccttaaaatctggttgtcaataaacatcaatacacataaaaattattgtatctatataagattggtaactacaaaaaaaaaaaaaaaaaaaagaatccccagaatccccagaccctgcagaattgggattgagggtagaatgacaagggtcctcacagctgacaatcatgggaacgacaaggagaacaaaagacatttcacacttctcaaagagattactacctgttttgaggatcacttgtcaggagtgcatcttctgtgactatgcagggtggtcaggtaaaaggaagttactacagtaaaggatggtgatgaggaatggtgagtttccaggtcactggaaactgaaagtctcctatgaactcgagaagccgcaaaaccaaggaagagaaagagtaattttataataaatgttgctgtggatttcttcatatctgttttaacacttttgagttatttaagtgtgtgactacttaattaatttttgttattgttgttttgaatgtggcatctacccaaaattggactgcattggtctctgtatttacaaggcttatatttgcatatattaacttaatgcaatacataacaaccagatgaacaatccagatataggggaaagtgattacaccttgtactgggatggacaaggaggacttaattaaggaatttagagaagctcagtcatgaaattagggtaaacttcaaacaagaaaaaaataaaaaaggatgggttgaaactagggtaggattgaaataagaaggaaatagatgaacattagagataatcacttaagtgaaaacataaaattgagaatgccttatcatgaaattcatgcatgaaattctgtcatgcctgttgatctgtttaaaaaataatagtagccacaaatattctcaaatgatcatgcatcgaatcttgtggaccccaagagtaatcatatccctaagggagctaaataacgtatgagtgtagatgtctattgcaatgcagtttttcaaaatgccattgacaatttgttgacttccttcaaggttggcttagctttctttctcagcctccaaaaggctatcaagtttcccatgtagttctttgagatgatcgatctatgttttgggaggagttgcaaaatatatgagatatagccaccttctgtatcagaaggattccctcttgggttatcagaacaatcaaagaagctatctgattactggaggagagactgacataaaattgtagtttttaacttcttgtgaaagttgtgagagcttgacactgcatgcaggagtaacttaagaacaatcttccctctgtggctttgaaatcaccccatgtgggataactacaaggcctgttattgttggaagagctaagcaatagtttaaagagaactagatttgttacaaaaatcaagatggctgcctaaaattcaacatactaggcctatttacgtatattatgcccaaggcacttggctggtaatacaggggctaaacaaagaaagaaaattagttcttgcctagggaaggaggaaaaggaataatttattgagtaccaattatacactatgccctttatatttatgtcatccaatgcacaaagctttattatgatttaggaaatattatactcactttacaggaaaaaagcaccatgaagtgaaaagaacattgactacagagtcagacacacctgagtttgaagtgtggcttagcctcttaatagttctaagaaaggaatttaacctcttcgaggccagttttctgattagtaaaacagggaagcatattaccttctattgtgaaggagcaaataccggctatgctgttttgcagttaacattcatatgaaaggtataagataataataagtaaaatgtattattttattaaatgtatatcatgttccagaccttattatatgctaagacttttccatatattatctcatttaatcttcatagcaaccaggtgaggaggggccaggaatttttccattattttacagttaaggaaactaaagctcagatttaaagaaacctgggtgcagtcaaatcaaaaaagattaagtggctgaaccggcatgagctatatcgtgctctcatctcagagagcctttcgcatagacatctgaggaggaacaaagggtaacaataacagctctttctctgaccctcctgattttcaagccagccccttccacatgcccacttcaacccttgccaagattcttgtgtatgagtaactctgttacctagtctagttttgcatgaatccctgttcctcttcaagcacttctttagcttcaggttttctaatctggaaacttctgtttctgaattagacctgaactaatttaggctgtcaaaaggtttgtgtcttgaaacttcccctgagtcggaacaataaatattgtgcataaatagaaactcagctgaaataaggagaagagttaatgtaaaaaaaaaaaaaaccaggtatacgtataattatattgtcaactaaaaaataaaatgaaataaaagcttcggcttcatacgtggattcagggattcacaagagagcaggtttgcagccacgaaaaagcaagcacagaagtgtgtgtgtgtgtgtgtgtgtgtgcgctcatgtgcacactcaagctgttgatggaacatagcatttgtgagtgaagggatgaaaattagaataggccaggcgcagtggctcacgcctgtaatcccagcactttgggaagccaaggcgggtggatcatttgacgtcaggagttcaagaccagccttgccaacatggtgaaaccccatctctactaaaaatacaaaaattagccggtcatggtggcgctccacttgtaatcccagctactcgggaggctgaggcaggacaattgcttgaatccagcaggcggaggttgcagtgagccgagatcatgccattgcactgcggcctgggctacaagagcaaaactgtgtctcaaaaaataaaataaaaagagaaagtgctcaaaagagaaactgtgtgaaggggacagtttagggcttggggaaaacaaaacaagaatgcgatctcacctagagaccaatttccacatgatcccacagggagctctggagggcaaattgcatcccagagctgatctcaccttgtggcaaatgggttggactcttgtactttcagtcgttggttgcaaactgacctgaggtggggcacatatggcctttcaggctcctggctttcttcagggtaagaacaagtctctggagaaggaagcagctgtgggcaacaagcactcccagcagctaggggatgggtgtgctacctggtgatggggacttcagtagaacatatcagtgcccactagagtcagagagaattgatttgggtcttaaagacagtatacaaacggaaattttattttattttgttttatttatttttttgagacagggtctcactctgtcactcaggctggagtgcagtggtgcaatctcggctcactgcaactgccgcctccctggttcaagtggttgtcctgcctcagcctccctagtagctgggattacaggtgcgcaccaccatgcccgactaattttttgtatttttagtagagacggggtttcaccatgttggccaggttggtctcgaactcctggcctcaaatgatccacccgcctcagactcccaaagtcctgggattacaggcgtgagccaccgcgcccgaccttattttattttattataataagaagacaacataagatctactctcttaacaaatgtttaagtatacaatacggtattgttaactacaggcacactgttgtgcaacagatatccagaacctactcattttttataactgaaacttgatatctgttgacaacgggaaatattttctttagtctcatgatattaaaaatgtatctgaatttatgatttttagataaagcactcatagagactattgggcaaaatacgaacagatgtattgatttctccaagggttccaaactggaattttaaaaaacttgagttaagattcatgcatatttagtaacaacctagtaacacggatgtatgccctcagagaatgggaatcagaatctaaagtattgtcactagagattgaaacaaagctttcaactccaattgttataaaagaaggaattagactattttgacataatccactgcaagggaaagtaagcagaaatatccagtgggatttggaggaaagctgtgtaaagggcgcttcttaaattggacaaaccctttcactctgctggagtccttcctgacacctggaaagaggctggaggtccagcagccattttagacaatgatgttacatcgaagaccgaaagttgcacagaaagatggaaggttcctgggtccttgaccaccatggccctgctctaccggcaatgtactgcttccagctggagctcactcatgtggcaaggcaacaaatctctcttacttaacacacttctatttctggatttctgatacacgcagccaaacccaatcctacctgatgcactcattttttaatactcaaaatgggaactatcttaccattatcactttttgttacacctcagattttcctgaaaaagtgcattgtcaaaacatatcattatttttaaaacaaagagtgtataaatgtattattaaatacattaaaaccagacaaaggctcataaattaatgcaaacgtgtggaatagtttcatcacacaagtgaaaattaaattggactgctctgccataataaagctctgtttgcctgctttgaaatgaaaagcatcatgcaacttttactgctgcgtttctttgaaaagtaccaaatctctcttctgagttgctcttgtctttttgagtataaggtatttattaccactgggataaaaacagaatgttgatggtcacatgatgcaggcagctgggatttcaactcaaggtcagtcactggaccctcaggcagccagatagtgttgtttattttttgccaaattgatgatgcctttagcctttaaataaggagcactgactatgattaaattttgtcctaaagagatatttcacactctaatacatagaatgtatctcattaaaattgtaacagagtaagaaaagcttacttcagagatctctcagaaaaaaattggagtacagcctgaagttatctaaaataatcagcatggaaccatgcagatttgaaatcagatgacaaacatgtactttcaaagcatgaacatttgaaaacagtaacttgcatcagtttctaaacgagggatttaatgtaactatcagaataatcagtgtgagatactgaaatataaaattgaatttgggtcttcagaattagaaacttaacagaaaaaggaggtcattgtagaaatgttacgaaataattttgtttttatgcctaatttagaaattgaatgggccgggtgcgatggctcaccactgtaatctcagcactttgggaggccgaggcgggcggatcacgaggtcaggagatcgagaccatcctggctaacgcagtgaaaccccgtttctactaaaaatacaaaaaaattagccgggcgtggtggcgggcgcctgtagtcccagctactcgggagcctgaggcaggagaatggcgtgaacctgggaggcggagcttgcagtgagccgagatcgcgccactgcactctagcctgggtgacagagcgagactccgtctcaaaaaaaaaaaaagaaagaaaagaaattgaatgaaagttcattgataatgcagagattctaaaataaatgtagccaaaaataaagccaatcagcataccaaaactattacaatcttagaaatccattatgatttttaaaaagtgctttttttttttttttcctctgagatggagtttcgctcttgtcgcccaggctggagggcaatggcacgatctcacctcaacctccgtctccagggttcaagcaattctcctgcctcagcttcctgagtagctgggattacaggtgtgcaccaccacgcctggctaattttgtatttttagtagagatggggtttcaccatgttggtcaggctggtctcaaactcctgatctgaagtgatctgcccaccttggcctcccaaagtgctgggattacaggcgtgagccactgagcccggccgaaaagtgctatattgctattccctactatttattattctgaaagagacatatcacatgtttaaacatttaaataacgaacaaacctcctgggatcatcatatttatcacgcactttttaaagaaaatcaaacatgcttctgtttatacaaatttattcccattctaaatatttattttacaaacagaatactttcttatattcttgggctacatgaatcattattatcaacagaagggtgtctgtcattacaggaagcacaatacttgtatacttttgagggttactcacacacacgcgcacacacacatgcacacacatacacacagagtttgggacctacaagactttataatcttattatgcctgctacccatttcatcttcttcttcactgtttgtcttgttgtatctctgttcgttgtggcctacccacccctgctcctctctgacagttttgggttgaacttacctggctctggttccaggagtgggtgtctgatggaacctgcccaatcagaacactgtactcctgaactaggttgattgattcaggaatgtgtaggtgatttcttcagagtcaattacaagtaatcctaggtcttctgttggagagaatggtgttttcattttctattggaattgaggtacaatgatataagtctaagactaataatgggtcccatatcgagagataatgtctaagagctttttttttttttttttttaagagcctttgaaaacacagtggagaaagggtgagagaggtactgggctaggtgacatcacttgagatcccaaaactaactgtatctgaagtaagtaatacctcttcactttttcgttacatgagcaaaggaaacttttttttttcttaaactggtttgctaggtttttgtaaattagcagaaatggtgcttacatacacacatatatgtatgtatgtatattttggttgagattaagaaatagagacctaggttctaatgatataactgactaaagataaaattaatccaattattgaaagtttcagcacctcagttgcctctttaaacaatgagttagttagattacatgactgacagttgtctagatctaaaatcattggatccaatcaattgattttcatgaatgaacaaagacatttaaatctggaagtaagttctattaaacctagtatcttgataaccccaggccagataaaactataaaaaaaaaatgactggtctctatatcagtcgatgggcaccattttatagttaatttatttcaggaacatggcagttataacacaggtaactataggacaagctggtaaacctcattgtaggtaatcactgagctcagggaggtagcatgatgtggtggataacagcaagggatagggaaggagaaagtttgactttcaaagtctaattctaactcagaattcttcatctgtaaaatgggaacaataatagctctctcacaggcttgtcctaagtatttactcacataatatacacaaagctcttattacagtacgtagcacaaagtaagtactcaaaatttgccatatgtcattattagctgcggagctattgcactgaccaagtgcttgaaaaaacaaatcatttcctttggcgtgagtgttaatgcacagaggctttgaaaaatactatgtgaaagtcattaaaaaaagaaaacctctcagcagattagcttccttcaacctttgtaagatcctgcttttgacggccaacccagtgctttccacactttctcacacattgcctgttatttctggtcaggaaaataaataaataagtgcccatctggccaagtatttttccacctttatatgaaccagaaataccaattgtttctaatgtgtattccccagatgcaatacttatcctctatttacagctaagccactgattactgtggaaaatattgtcagcaaaccataccccaaaatgtattgctgtgaaaggggaaaaaaatattacaaaacaaaaccctaaaccgaatcgataacagcactcatgtcttggatagatttacagaaagagaaggacgtcgctatttttatttgctaagagatgttgcctttttttatattaaaatatttaaagttacttctctgattgatctgtttcttttgagacataatcttgctctgttgcccaagttggaatgcaatggtgagatcatgactcactgtagccttgacctcctaggctccagtgatcctcctgcctcagcctcctgagtaggtgggactataggcgtgttgtcactatgcctggctcatttcttttcattttttttttgtagagatgaggtctcactctgttgtccagggtggtcttgaactcctgggctcaagggatcctctctctccttggcctcccaaagtactggcattataggcatgagccaccacacccagccactctgatttctgagtcttaatcaaagtagcaaacttataaagtagtgatttcatcacatgccaatattaacaaagaaaaaggaagagtagaaaaaaaactccataactgatactgtaaaatatttttctaatttgcataaagatatcagttctaccctagtatatttacaagatatgacaattcactaacatttacattttaattcatataaccagtttgtaagagaaggaatcctatcaaggaaaataagcctacagaaaactaactttttgtgataaaatgattttataaagctgacaataagcatttaaagaagtactagaacatgaacctttaacacatatccaatctactgttttagaaaaaattaagaatgagtttttctgcaaaaatgtatgcaacgcaaattctagtttaaagcggaatatcctgtaatctaataaatatggagatgattttttatagtgatgtaatgggctagattgtacctttagacttatgggaataaaaatattatttcctaatttcaaaactattttaaatcttttaaattctactaaattaaataagaaaataaaatttgagttagccactcaaacaggagatttgttattctgatttaaaaacaattgcctttggtaacaatcactctcaaacagttcgagaaaaatatatgtatgtatatattcatgggcaaggagaaggatttagaaaaggagaaaatttttctaagtttcggtgatcaattggaatgaaagtgtgaaattaccttcagcagtgttgtcaactaaactcagcactttctgtctcaacaggtgcacactcaagcccaccaactctcagctatttgtcaaagctaaggaaaaagatagccagtccccacacagctgcgcctctggctgccactacaaaagaatgaggctcggctatttttaggtttggggtaggcaatcagccaaatctcagcagcaccacaagagcatgtgctgagataactgagactttagagttgaaccaggactccaccagcctcccaacttcctgcctagacacccaaccctgtgttctcatttctgtggtcaccaagtcacctgtggctttcatcatgatccgcgaaatctacatttctgtgcttttcccagctcctctcctgttacaactttcatttcttatctctagaccttgaagccatgaaattttccttattagttcctttactcaacaaggaaaaaaaaaaacctcagaacactctgcagctgcttctataaagaaagcagtgtgggtttaatttgtttataatctgtccttcatttcattaagcctctaagtcatggccattgctaccactgtgcttaaaaacaagagaaaagtgaatgcttataaagagtggcaggtacaataactgatgtacaaagaaggaaaacacagattactgtgttttgatagttaaaagggagccagaatagggagctaaggagtctgatatcaatagcgtacattattttacctttgttgaatgctgatccagaaggttaatatgtctaagaatgtgcatttgtgaaatttccctatgtgctagcataatctcactaggtgttgcatgatttccatgaggaaagctgggttttagtggaataaattattctacattagatttttttgtcttctcataactgttttttatttgtaaacaaaagtacatgcacacatttacggtatcctcaggtattgctatcaaaacagtaataaaataacgcactattcttttttaatgatttttttttgttgtgaactgacatgagctttcatatacgaaatccgattttgaaatataaggcacatttattttgaaattaatagggaatctaggtcaaacaaagcaaagccaaaccttaattttacagaactgttctacctctacaaaaagtcactcaaaacaattgtttaaattgtgtgcaataattatcttgaaaatgcattttaacatgttcctataaatataattccatatgactaagatgaaaataataaataaaataatagtggaataaaattgatactttatttcctattttgattttatccccattattccagaacaaattcaatatggcagataaattgcaaggatttattttttctttctttttttttttttttttttttgagacagagtctcgctctgtcgcccaggctggagtgccatggcacgatcttggctcaccgcaacctccacctcctgggttcaagcgattctcctgcctcagcctcctgagtagctgggattacaggcatgcaccaccacgcccggctaatttttgtatttttactagagatggggtttcaccatgttggtcaggctggtctcgaactcctgacctcgtgatgctcccacctcggcctcccaaagtgctgggattacagatgtgagccaccgcgcccggcccagcaaggatttattttcagggagccagtattatgcagagatcagcctgctttagaaaatacagtgtctctcatgaatgagtgcaccatttgccaaaaataatctattgtatcttcttctcaggccaataattaaaaatgtattatactccaaagaaaaacgtaaataaaaaagacaatcctgtaaaattatatggttattgtatctctacaaaaacgtttttaatattgtaaaatatattatttacataaatatgtaaacattcaaattgaggagcaagttttagagtagggctcaaaatctcatatctgccacttattagttatatggccttgagaaagttacttaagcactgtgcttcggttttgttttttaatctctaaaatgggaagtattctttcctcatgatctggttctgaaaattaaatgaggcacaaatattcacactcccccagggttctctaatcctttccttgatagtgtattccctccgttagaaatctcgttctcttctttaacttcaactatcatctatctccatgtaagtgattctcaagtatttctctcttaagtctaactctttagttttagtcctcccccacaaaaacttttattatctacccacctggatagcccatcaacaattctaagttgatgtctcaaaacaaaaggcccttttccccttcccctccaattttgatcctattcctggtttctctacttctgttaatgttaccatcatctcaccagttcctcacggtgattagctattaacaattttaagaattccaacatatgcttcattaaacattagataaatgggcatttattgactgcatgttaaagaagttccatggtgaaatgagtttgggaaactaggttaaaagttaaacagctgtctttcctgcaggattccagagcatctttgcatatgcattacattgagaaactctaaggggatttagtatgtagtattcccctcagttttatgactaaagaagtcttttttgggggcgtggggccaaacagagggggcccataatgaataattactgtgccatagagcactcttgggggattaatatcagggagtctgctatcattattcccttttcctcatctcccacaatttagcaacaacttactaccaaataatttggttctccttgttgaatccctatctcattctgagctactgcttttgtaaatctggcctaggctacatgtaggctctcctttcactgccttttcttattctaacatctcaaactctcaattcaatatcttctgtagaatttgagatctattttctgtaagagatacaaagatgggtaagacatgatctctattgtcttgggatctgtgagagatgggaataggccagcagagttcaaatatatattcaataccataggcatagacataccacataaatgttgtgaaacaagaaatagcagtcaatgcttatatgggaaaggttacattaggtttttttaaggaagtgggacctggataatattagtccaggaacttctaaatgaaagatttaaaagtatttatctaccccaaagactatcttctcatcttaaactaaaaataagtttaaaatataattaatattttcacaataaaatgctcactggagaaactttgaaaaaaataaaaatgtaaatataagaatattgaagtaatccagcgtgtaatttcaccctagatacatctactgctaatgatgggtgaaattttattttggatatttgacttgtctacaagtcaacaattctaaagatttagcttccagagctaaagttttctaacaataatgccaattaaatgttttaaaaggttaattataaaagatatgatgattaaatttaaaatatcttgtcacctcctgttcacaacattttgcttttcatttccatatatcttaagtatacatctgaaagctatgtgagcgttgtaaattgtcaagttgaacttaacaaagtatagtttatgttggggaaaactcattaaaatgggatccatttcttaatttccaaaagaatcatctatatgaattgaacattgatttaatatcattgaatattcaatacccatatacacattagaatgtttttatgatttacattgcttacagcacagaatattcaccaatattattgctaagagtagagatatgactcaaaagtatcaatatttaatccagtaagtatgaagctctatgttaattgcaatcactattcataaacaatttgcccaacattgcctaaacatttcttgccattcaagggtttattttttgccttctgtgaattagagtatgatagtaaatggtaataaatgatcttaagtgatagtaaataagtaatttctataacagaataacttttgttctagagatatgtgcaaggcacaatatcactacactcaactgtatccaaagcaggccacagatccttaaagagaaaacttaggaatttactgtggcaacaggagaggaaaaaagcaaataaaaaggaaatgtacaaatgtaggtatgaggaggatgtccttttctaaaaaaaataaggtagtttagcatagttgcaatgtgtggtatatgagtggggcaaaaaatgaggtaggaaggacaaataaaggaccagtaacgaagagcttttgaaatttatttcaggtctgggagtgatgattttgacttaattccctggttttctctaatactgtttgttgttgttgttttctgcatatatagaaaattggtagattttatacatgtgcattacatatgtattggtagattttatacatacacatatatatgtataattacgtatatacatatacaattgttgaatcattaagttgcaataattaaatttattactctttatgatgctgtgggtattacagaagcattgtaaggtactacatggtcctcttataccatagattttttctaaacctacaactgtatagcgtgtggtatgatatgaaaatcactggctgagaactagctgggtcttagttttgtatctaactgtttctgagaactggagtctcactttccacatctatataatgaggaaatggaaaatattctccaggttttctgcagttgtgatgatctatgaccttgttattcactgtagggtgttaagctggtgaaacagcaaaactgcagaccaaataccagttttcctttaaccatctctctctctctctctctctctgtctctctcatcatctatctaacatctactattttaaaaaatcatcagtcttctcaatgcatatcttactttctccattttcccattcttccagccctttgctcttttcggacaccttttatttacccgtctacagttcttttgccctctggtactttgtggttaccagttgctattgtacttcccacaaaggatcaatttgcactacaatcatactgacagcagtcctcagtaactcaggggaaaaaaaacagactcttaagcagcagtggggatccaaagaccatttcccagggaaccagtcgggtcacaggaagagtgggaagagaacagcaaagccccaagttattttcctcttcccacatatttcactcagatgccaatttttgtttgctctcaaagctgttttatttgacagggctccttgttatgggctaaattgcccctttcccaaattcgtctgttgaagtcctaacccccattgtctcagaatgtgactgtagttggagatagggtctttaaagaggtatttaaggttaaatgaggtcactaaggtgagctctaatccaatctgattagtatccttataaaaagatgagattagaacacagacaggaacagaggaaagaccatgagaagacagatggagagggcagcctctgcaaactaaggagggaggcttcagaagaaatcagccctgattatacctagcctttactactgtggagaaaataaatttctgtttaagaaacccagtctactgtggtattttgttatggcaatgctagcaaaataatacattccttattcatttgtaatgttttatatttgaattcagatcattctcattctcccctttgtatatatatatagatatatatccttcttgctgctagaacaataacaaaaagatgattaactgtaagcatagtgttacaatgaactctgttgctcacatgcccttagatatgtatttgtttattcaaaaaaagcattaaccaaataactttatatattaagccttatgctcatctctaggtatgggggagaggtgggaaacatgatgataaaataacagtatccgtgtaacactgataaacatgccaagatatttgtattctcatattaaagtaaataaattgacaaaatatggtgaaagatattgtgcattttgatgaacttatgctatgagaacactttaaaaccatacctaacctccattggcggagtcaatggagattggtgagaggggttaggaaataatttttcctgagatgaagtggaaaccaggctttaattaattaagtgattggtaaggagaaggagggtaatttcaggaagacttatccctgacaacacgaaagcatggtagtttgggggcccgcacataggagcctttggctaaagggttaggagtaagagatgaggagaagggtaggagaggaggtagcagcaataagctgggtcctgataacatgaccttacatacatcacggagttggcattagtctctagcaggaaaaaatattttccaacttttaagttaaggctaattttaaacttgtcacctgtagtaatctctttaaatgaatgaaatttccctgtcttcatttatagtaatcagcatctttcactgcaaggaaatttctaagtgaatgtacattttactcaacttctaatttcctttaggaatctaaactcattcaatattttcacaaaatgataactgtaatcaaggcagagagctttatttcagctaacaaagaatagccctacacaaaggaattgcaaatattctaaataatgactgttataatttatcttctctgttgaaggatactacttcctgttctgtttgtagccatgataaacaaatggtatcatgatccttatagtccaggaaatggactgttttatgtagatgaaatattattattataaaatctgtctcacattccaaacccagcctaggacaggatttatgataactgccccccatctatgctggatatcacactatgatgacgtgtgtatttgtatttctgtgagctcaattcataactatgcaactctcctgaagcataaacttggctacatcaaaatggctaaatatttggtctaatgtttttctttaaacttaaattataagtttagattacataccttaacttacttaaacaattggctggacatttgaaaaaatattgatctttctttctttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggaccacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccagcctgatctttctttctatacatataagctttctgtccaatttataaaaggaagtagtactaatatataatatataatattatatatatatatataatatataatattatatattatataatatataatattatatatataatattatatatatatataatatataatattatatatatatataatatataatattatatatatatatataatatataatattatatatatatatatagtgtacacctatactgccctagtaagaaatcaggaagtcagtattgatgatttgctctctactatttttgtctctctcctcattacccgcgcaaataagttttactaattaaatatctaaatatcttttgtttgcattttgtctttttcattcctaatgccctaaggctcttatctgggatataactgcaaccctcttacacctgcttttagaacagtggctctaaacacaatctgcacttggtgtgcctgtatgttctgatttcattggtctgcaagagttttcacaaaccctgtgtcatctaacaaatagatctgaacctcctcctttaaaaattcaagatgcaaaaataaacacttcttgacaacacatagtttgctttcttagcttttttacttttacttttttttcgttttttttgagatagagtctcgctctgtcacctaggctggagtgcagtggcacgaacttggctcactgcaacctctgcctcctgggttcaacggattcttctgcctcagcctcccaagcagctgggattacacgtgtgcaccaccacgtccagctaatgtttgtctttttagtagagacggggttacaccatgttggccaggctggtctcgaactcctggcctcaagtgatcttcccgccttggcctcccaaagtgttgggattacttgcatgagccaccatgcctggcctgctttatggttttattttgctcactgtctaagctagtactaggtgaggagtagatgctagaaacccattgtaatatgttgctcagagccagccatttctctttccaccattcatacccaaacccaaaccaaacaagaataatgtgagagatcagccatgctaggacctatcaattcagtcatcgttaagcaacaatcactagagacttagtacatgtgatatgtaacagcagtcactgtgtaaataaactcaccgcctattgtgagaaacagacctgtaaacagtggataaaggacaagaattgcatgcagttaaagaaaaacaggcaaaataccctgggaattcagaggaaggaatgccaaatcacccagttcacctacatctaaagaaggctttttttcttgttcatcaaaatactcgtgttggaactagcatgaagagtgtcacttcaccttctttggccttttttacccttttgtgtaaaagaagattcttgatcttcaaagcataacagtcatgttttattttactctatgagcagattcattaagaatgtgaaagtattcccattcattcaaattaacattaaaagacactctcccaatgaataagatgtcaaaaatcatgttagtaattgcagtcaatgaaatgaatgctctgctctcatgctgcatgcctatttgtactcatcgactgagcactaacgagaaatacacacctaacttagaacagcagaaggagcagatgctttaagataatatttctcagtaatatgcaacaatttaatttcaaatactgaacttctgggccttggaaattacatatacaggttttgcagtcaaatgagtattgtttagacatattaaatgtgctgagatctaaaatttcatcagttttcaaatttaagccagaggggaaatataccctaatggttcaaaaaccctcaatttaaattctggtttatatagcaatgatcttggttactttaaatttatttctaagccatgatttttttcttttagtggcaaatattacaataataaattcaagggaatgttaaaatcatacccaccaacaaaaagtaattcatacctctgaagttagctattttagttggacaatactcttaccttgcgacttatgctattagattcctgtgttcatctttttatagcacacaaatacacaggtgttcactcacacagatgcattcacgtacacactatgaaacttgagttttacaggaaaaaaatttctaaaatgtgtccaaataaattctaactgtaaaatttcttctctcggctgggtgtggtggctcacacctataaacccagcactttgggaggctgaggtgggcagatcacctgaggtcagaagttcaagaccagcctggccaacatggcaaaaccccgtctctactaaaaatataaaaattaggcgggcatggtgggacccgcctgtaatcccagttactcaggaggctgagacaggagaatcgcttgaactcaggaggtgaaggttgcagtgagccgagatcacacaactgcattccagcctgggcaacagagcgagactctgtctcaaaaaaaagaaaacatttcttctctcttatgtacaaatttctcactccatttttctccaatgggaatttaaatttggaaccactctgaagctaatgtaatcataccagatacataaatatttcaatatgtatagcaattgattttgttacagtctttgataaaagagatacagtgtatagacacaattttaatggtttcctgcaattggaaagatacttggtatattcatcaattagtatcctttttatacttctattagaaaggctatgtttttgtttaagtacccaagattccaaaagtgaatttgtatctatgaatacagtttaatgtgaacaattgaaacgcgcatgcaaaactcaaatgaattgtatacctggcaggcaggatgaattgatagcatgttatttttagaaatctgagtgtatgtatgcataattctagtttttgaagttatctgagagtctttccatatcatattatacccaaaaaattaagtgtcatcatctaatggtttgaaacaaaagaaatttataagtaacttataattctttccatcacttttggatattaattaattcaaaacacatttataaaacttcttcctagtacaaggaaatattcaaaactctatgagaatataaacacatagaagatgtggtttgcggcatccaggagtatataatctagtagcggagataatataatttttaaagttatatttcaaataatatagactcagttacctcatctgacaagtgagaatggtaatatattttttgccatagtttttataaaaccaattatatgtatattatctttattgtctttattatcattatcattcactataaaagataatgaatatatgcaaattaatttttcagtggtagaacttgatttctagatgtcatgaattagaactctactcttttccatttctcaatcagagtctatattttcaactttcaaaattgcacaccacatttctacaatgtgagccccaggcagaagaatgcttataagctttcatctaggcacaatatattatataaggcctggatggttttctggctggtcaattctctgcttttggcatacggagatcaaaattgggttatatgatctaatttagttgaagataatacaataatatacactttcattaagaaaaaatttaattatggaactatcatcataaaaattgtcatagataagaacaaagatactatatcgcatcttttctttggttgaaattttataagtcaaaatagattgtcatgtcacatacaagcctctttaacaaatctcctcaaagataaaatattaaagaaaaagttactatggtcttattagtttacagaaacttaattttattataaaagcaggtcagagggcctactacttcagtaaattaatgatatcactcaagctaagttttctcataaaatgcctgtgcataccagatctgtggatttctgtaatactttggaaattgaaagggttcaagacaccagtttttaaaaattcattattacatgaataatatgttaacgtaatatacaaaatatagttcatattcactggtcaataaaatattacaaacatttaagtgcaaaaataataaatatgaataggttgttagactggctctgtagatcctatttttgttttcagagtccattcaattccatgtatttgagtcatgcaataaacatttctcaccttgaatttgggcatacttgtatggggctccatgcttgtgcacacatatttatccagacactaagtttccttttataaatgagctcaatcccagattaaaacagatgaaagatttccaatcattgtggccagctcccagggtggaaaataagcttaggaatgcagcaaactgaaactgaatactctctggaatggacattccgttctaagtctccttcaggaaacctccaacaatagctcaagcaggagcaaacacttgtctttgaggtagtccaagccaaccattcactttctcagtaatctgtcctcagacacccactggacttagagctcctgtgcccacctcaaaggacagcagccctggcatgcatgcactataggagcagaagtgattctccaaatttctactctgctcacctctccaccactttgcatcaatttggcatctcctaagatatctcagctttgtaactcctcaaaggaatccccacaaattggggctcttttttaacttggacatttcctttgagactaagaaagaaagagaaaacaaagtacacagataaccaaaaacacgacagattatatgaatcatccaaattaagcaaccaacattttagtctaagatttataatttttacaatatattgagtacactggacaaaaaagtatctacttaggattatcccatcctgttctattttgtgtgtgtgtgtgtgtgtgtgtgtgtgtgtgtgtacaaaataatgcatgccagtattcataaggcttttccaatctgaatgatgcctgagtttcaaatatgtatacagtgatgtaatggctaaacaatagtcagataaatgctgtgtagtcattcatttgtgtacctacaagctgttaggcacaattaatccacatataataagcacaggctatctcctcaaggagcaagagagtgagtcagaagccgagaagcaaactgacagctaaaataggggatataattgcttgtctagaattatccatagtgagtttacaataagaatacatattggggccccattttctgacctagggtagtaaggaattcttttaaacaatattctataaggaaagataaaaataatattaatagtcattggtggaagagacatggtgatagtggtttttgggagaacattccaagaagtgggaacaagtcatagacacaaaattacatgaaccaaagttattttatttgctgaaccaaagtaattttatatctagacagaagtgttcctggtggggaacagcagatcaggaggtgagagacatgagcagatgccatactgtgaaagaccttgtacgttaggaccttggattttaccctgaagctagaagattctctaaaggacgttaagctggaggcacacaatcttatttgttttagaaactcaacgggggcagcaattacaaggtgggattttctgaagaccagattgaaagcaaggagatcattcacacacgcacaaacataaaatcagaggtagtcttttgatctatgtatctgtttatacaagttggtatccaaatgtacatttatcttttagagttatatacattagttatttgtgattaacaataatagttaaaataatacaaagaaaaattattctcaacactttgaccctcaccaagaaactttatatatcccccttttaaagccaacaataagtaagcttgtgaaggggcattatttttcctaatttcctcttgaggacagtagtagacatgctcagctcagtgccagaaatatggtaggctctcaattaatactagttaaataaatattggcttgtccaggattacttgcctttgtaggtagaggcaagtttaaaacccaggtagtctcaggcattgtcaagttaccatgcccgtggaccagcataacttctagcgcttgtcatatagggtttttggtcataaacaacctgaaacacaacaccttacaaagtaggacatatagaatacggcctccatcatcatgatattttattcaatcagtgatgcacgttcccatataatagaaatggattgcattctagcagattagcattaaaccatcctttgtaccttgagtgatagacttattaatttacaagacttatcctcgattaggtttggtgatgataccctagccttcagaaaaccaagagcttattaaaggtctaatgctgtatttttcaaatttttattttgcaatcattatagactcacaggaagtcgcaaagaaatatgcaacaatgtcttgtgcaaacttcactttacctctcccaatgttgataccatgtataactatagtacaatataaaaactgggaaattattgctataattcatagagcttattcgggctttaccagatagacaagtatgcacttgtgtgactctggtgtgtgtgtgtgtgtgtttgtgtgtgaagctctattcgacattatcaagtgtagctttgtgtaacaaacaccacaatcaaaatattgagcaggtccatcaccacaaggctccattgtggcaccattatatagcataccctctgccttattcctgacctctggcaaccaatatctgttcttaatatcaatatctgttcttaatatctataattatatttcagtaatgttatatacaagaaataacacagtatttaacctttgacttttttttgctcaatatggtgctcttgacatccattggagttgtgaatattgagtatcagtagttcattcctttaaattgttgtgtagtatttagtggtatgagtatataacagtttgtttaacagtcactcattgatggatacttgagctgtttcttgtttctagctactgcattcatgtcaaggtttttgggtgaacataaacatcaattttctgggataaatatcaagagtacaattgctgggctgtatggtgactgcatgtttaattttagaagaaactcctaaactgttttctagaatggttgtaccattttacattcccatcagcaatattagaaagacccagttcctttgcatccctgttagctttcagtgttgtcactgtttttctttttttaattttagccattctgataggtgtatagtgataactcattgtagtgttaatttgcatttctttaatggctagtgaagctgaacatctttttatgcatttctttaccatctgtatatcctcttcagtgaaatgtctattaaggcttttcccacatttttttccactagattatttgtggttttagtgctcagttttgagtgatatttatatattctagatactagttctttgagactttacaaagatagattaaggaaagaaaaaggacatgggttaaaaacagtaaaaaacaaaatcaagaaccacaagtgaaaagcagtatgggaaatcaaaaaagggaacagcacccaatgacaaaaagcaaatctttattatatatttatatatgaagctttaaccaaaatgaaagtgctttgtcatataaaattttcataaaatgcaatcaaaatatcattattataacatattatatgtaaacatctgtaattatgttcattaaagcattacacatcaagtaacttatttaaaaatatatatggggaaacctaatgtgtttggttccaggtaataaagtggtgagcaagaacagttgaggtgtcttggttcatagaacttaccacataatccgactggcaagtattaattagtcacgtacatacatatggaatcataacagtgctatgtgttatgaacagatgttacgtggtagaggaatttgatgtacttaggggattttgatgtctatccagaggtaagcttgtaggtggaaaatggtgtcatcaaggtaaaaaaggggaaacggggaggttctagacaaatagaaaagcatacacaaaagtactgtagataaaaaaaaaaagctatacctagtcagggaacaaaaagaaagccagtaagggggcgaggcaaaggaaacatgatgggaaatgagataggagaggtaggcagtgtctagactttgatttttaaatgtgttttgttttgttttgtttggctttcctagcaaccaagagaaactactaacatgatttaacaagtggtggtatcttcgaatttaattggctgcatgaagtttagagagtggattatcaagaatacgaaagagaatgcagagaaactggaaaggaaaggctgctgtattcctagtgagagaaaatatattgcgctaggatgatggtagaggagataaagagaagtggatgaaaatatattagaggataaaacccacagtgactggcaatgacttagaaataactgggtaaaaaagatcagagtttcaaggatgagatatgtttctggcttgtgaaactgggtgaatggttgcaccattcaatgataagaaaaacaatgagaaggaagcaggttttgtgcggtgaagagaaagttctgtttagggcatttagagggaggtgactatcacataagaatggagatgccacccaggcagttgaaatcacagttctggaattcattggagaaatctaagctagaggtataacttggttagttatctgtatataagtgttaataaagctgtggacataagtgcaatgatcgaggaagagatcattatgagaagagaattatgctaggactagatcccaaggaaacctaatttttaaaggctgagaagagaggatcagcctgcaatgcagactgaatacaaacaccctccaaagtagtagtgaagccatgagaggacagtgcacagatcttaaagacgacaacatttttaagaagggagaaaatggtcactattgaccttctgcaagttcaagaaagacgaagaaatttcattaattggttctagagacatgaagtcctctacttcacttgaacttagcagggtgaagcttgaatagaaaaataatgaaagcatgcaattaaaagaaaagagaatctcaatatcttgtccaactgatgcatataagagatagaaagaagataatactttgctttatttttgtatttttaccataacagaatttataatctaattttcttaaacaaattatcaaaaaagaaaccaacaaagttactgctaatgttgaatattaaagtactattattaatagcttcttaattaagaaataaataattatatgtttgttacaattgggaatgacatttgaatataataagttgtttttttttcccaaccgtgttgtagtgttctttacacttttcaaatggaaaaatgtattcagtgttgtattatttatcatgttactgatcttatcagtaaagccaaaaactttcatacgtaaaccacttaatttccaagtaatgtgtatgtatgtgtgcctctgtgtatgtatgatagacagaaagacaaaaagagaagatctatgcacactagtaatattgaaagaaatgagctaatttacttcattcatcacactgtcataaagactttcttttttcctagaaaagtggtatctcatacaacctcatctaatctcatacactagaaaaatggatcagcattgattaaaataaaataaattctaacaatttcttatttttatataatcacacatcttagtgtcattatagcagtaagttataaaaacaatgtatatttgtatatttaatattaaagagtagtgctacaaattaacctactgggtctccgaaatatatttctgaattaaggcttatttctatagcttatccaaagatcaataaccttacagttaagaagatgcattttaaataaatgttaaaatttatattatcctgatagttttatatactagttagttactggacaatactaaacaattgataccatggaaacgcacatgataatcaatagacttttttttttttttttttttttttgagacagagtctcactctttcacccaggctggagtacagtggcgagatctccgctcactgcaacttccacctcccgggctcaagtgattctcctgccacagcctcctgagtagctgggattacaggtgcacgccaccacgtctggctaatttttgtattttagtagagatgtggtttcaccatgttggccaggctggtctggaattcctgacctcaggtgatctgcccgccttggcctcccaaagtgttgggattacaggcatgagccaccgcgaccagccaataaccaataggcttttaatttgaaataaattattggggagtatttctgacttccctttgcctcccaccctcatttatacatcttgaataattctgttccatcacgatctctgacattatttttaaatatgtagatatgtgtgcattcattacctctttatgagatgagagaataaaattgcttgtgaagtcagagaaactcagtattatttctaatcatatatatgagaatgccaatgttgacgttatcgtacagagtgcacattgcttaactccaggggtgtcatttacctcatagcataatattaatagtccacgttactggtacactctagaattgtacagtgtacactatatgaatgtatgcaactaaatatcacactgtggatgactaacataatgaagataagagaaaaattagtttatgtaaaaaggcaacagtaattatagtaacttaaataacctactgtttatgccaagtactattcagaatagtatggcacgttaatctatgtaaaccatttttttacaatactaaatcatgttcaggttagcccagttcttagctttttgttcatgtagcacagttgcctgtacataactgaaataaactctaaaagaacaactagtgagaccactctaaggatggctaactgtagatgattacaaacaaaccagggctgcattagttttatttttgatctttttcatcttcacaaagtaagaagagtgagatagtaataaaattgtgaaacaagataactgttatggatattatcatagacagctccctatgcaagtctagagaatgggcatgagttatttaggatatctcagtttttatctaagaaaatataatatgccaatgtctataggctttgagtaaacaacccaaaattttaatgggttttatttttaaagagcatcctcaatgggacatgtctagttcttgttagaagatactatgattcctgccattttatattttgttctatcctttttagaattctattaaaatctgagagatcgtgacaactgactggttaagaatctttaatcctactgtcatgctgccaccattaaaatcctgactctaccacgtaccagctgagctaccttaagcaaattacttaatctccctgtacctctacatattcatctggtaaatttagatgattatgtttccccaccttctagagttaatatggaacttatcacatatgtatgtgatgtaatcagagaagtgcctgacacttattacaggcttgttaaatggtaaatacagtattatcattgaagattaggtgaatctagaatagtgctatgcacacacaaggtactgtcaatagctgtgtatgtaagacagatcaatgtttcattaatcctttttgcctcactgcttcttgcaatcattctctaattcacatctctgtatgtccatactcttatgcctatttataaaaatggattcttcaatgagaatgtccataatcacactattcataagtaatcatttatgattgatttgtaccatgctttataactttcttgatattttatagtagttgtacgcatatacatatgtgtgtgtatctgttctctgacttagagttgctgtctcataaaaagcaaagagaacataggtgttcaacaatgttgagttataagcaattaaaaacctaatgttaaaaaaagttgctcaatatcatattactattctatcgagtcttacttcctccaaagctaactgataagtacattacattcatccatgattagattgaattactcaaatgccttctatctctttattgtgattctggctttatttaaactgaaatgtcaatgttttctaggtatttttaccatttttgcagatattgggataatcactttcactaacggtcctccagaatttttagacatttctccaataagcatctatattaactaaactagcattaaataaagtgcaaacttaccttgtcataactatgcaattctgtattctctaaaggatgatttttcatattactcaacaattctgactgagcaattgaaattgagactatgataaatgttttacactgaaggctcatttcattatacagtagtcagttgaaatggggtttccgaagaaggtatttttaggaagtgcagagtacaggaaaaagctgaatacgttatacaatttaaatatttattgaagcttttctactaaggcaacattttggtaatattcacagaaatagcaatatgggaggaaattaggggtaaatagatggtagagactgtggaaaccaagacacctaatgctaaaagtgggatcctcattcatgaagtcattaaattggagatcgaaaggaacagacctctttatggaaatattattttccttagaatttcatcattttttctagatgtgtcttctctgattttttttttttagtgcttttgtcttctttattgaatttccgatctcctcttcacactctattatctttctagctggtctcatccactccatgagttgcatatttaaatccctaataatgacttcatttctaggcacaatacccacgcgctacataaaaatacaaaacaaaacaaacaccttagcatccacacccctaatccttcctgttgttccaatttcccttccaatctccttgcaaatggcaccattatccacccaggtgtgcatttcatggagcacacagcatgcaatacaacaccaattcctattgattctatctcatatacaaatcttgaatagatttacttctttcatctccactgtccccattctagtccaaatcaccttcttttggatgagctaccgtaattgcttcagattgatagtccttcatctaccctaggcacttgccaatctctttcacacaaaacagagtgatagtcttaaaaaatacaaatatgtttacatcagttttctacctgaaacccataaggctgtccattgatcttagtataaagagaaaaataatttctataaccttcaaggctctgaatgattggaccccagtcggccattcagatgcaagcttgttccacacttttctgccctcactgtactctaggaaagctgtacttgttttagatctttctccataccattttccacattcagaaacattgctccctctgacagggacatttttgctccctcttttcttttggacaactatactctaacctcattcttctttgccttgctttgaatattttttttttctcagaagtatttccccaatttcgaagactggtctaactctccctattatacattcttattacaatgtgtgctttattctatagcccttatctccaatgcaagtagtttgcgtgtgtgtgtatttaatatgcacatcctccttgaaatgctagtctctctttgagttcacttgtttagaatactatcgccagagcatagcacagtacctggcacaaaatgggcactcaatatgtgtatttgttacatggacaaatgaatcaataaatggataacaaatcatcagctgtaagtcccttctttaaactgtggtcacccaaaaccacacaatacaagttttagagagtcacttattttgatacttttatttttggatttattttgagagccaatccattttcagacatttaaagtaaaacactgcaaaagccataggcttgagcaaagtgaacctctgtgataacacttggtgctctctgacagcccattagagacggggtgtgtacacctaatccaaaggaatcctctagctcttcagcagctgttcacatggctcatgccctgcccttcagcgtctactaaatcaggattccccagctgtctgagcttcccgtaagcgattttagttaaccacctacaagccaacatttcttgcatctgattacgctctttaaagtctaatttcccttttgcttcctagttattttgcaacatgtgagtcattgggattcatcatttttacagattattattttttcacttactcaactagtttattaatattttgttcacttagtcaccaatttatttctaatacatcgttcttaagcaccaacataaaaaggaattactcaatttgcctttgatgaaaatacgtgggccattctgattttgtgatttttctttcttatttctttaatttttcctcacacagcttccaaggctaaaatctgcacttgtaacagtgtactgactcccttgccctttaagtcagcacttagctcaggctaaggtactattgcaaccgtaatctgataaaggaagagacaagttgagtgcaaataaagatgagtgccaggaatgagaaaaaagctactgatgtttatgcccttttatagtcctgattccatgacagtcttagccaaaagcagagtggaagaagggagaacgctttaaaacaaaacaaaacaaaagccaagaagagggtaaaaacatttaaagggtaagcattttatttgcccataattggaaataatatgggacaccgtaatggtaattgtgctcagctaacactgaccttttttaaaaatcaaaattttcatgatagtgaagacaacacatttaaaagttgacaaattagcaagagacttcgtgatatatatgtgaattcctcattgttgatatgcccatgtatggttttcatatttattaaatataaacaaaaaacatcatgattcgagcatctgattttttgaagtttctttaaaattatcttaatcctctccaaaacccattaagccatctacattctcatttcattacatggataagcattggctttaataatgcattttaatgtacctcctcttcgttgacacaaccacatttttctactaaaataaataactaaactaaaatgaataataaacaaaaataaaggcaaagctcttcctcagattcttttattcaaatggcaattagacctacatattattcaccagtcttagatatatttcagatttccaaattggcatgagaaaatcaattcatcaatttgctagcatttttaatttatggacaattattttcttaaaatggtatgtaatcaaaatactgagttaaaaattctgaaagagtcatttaagaacaacaacaaacaacaacagcaacaacattttatcagcatggcaaggaaatgacaactccatttcaattaaaggatcattgtccattctcccccagttcccattagtgaggaatggggttcataatgacagagtgaaagtgaggcattgagggagaaggcaaaagatcacaaaagaaagcaggaatacattgatttctaaaccaaatccagactactaagaacattggttttctcagggcttactatcattacatatactacgcaaagtcaccttcagaggttgtaggcctccagaaaattgctctgtgtgttccgttgcctactgaaattcccaagtattttgaacgagtgatatcagattaaaataaagatcgagctcagagttgaatagaaattatcccttaaaatggcagcctaaacagaagatgtgagctataaaagagggagtactgatctttgtgtttttaatgggaatgaggtagaggttgtatggccgtgagatgaggactctttttattttatttttttttaacttttaagttcagggctacaagtgcaggtttgttacataggtaaacttgtgccataggggtttgctgtacagattatttcatcacccaggtatcaagcctagtacccattagttgcttttcctgatcctcttcctcctccaaccctctaccctccgaaaggccccagggtgtgttgtttctctctatatgaggacacttttaagcataagacagcagagccatttcccttcctcattctcatttgtctgctgcctatcagaattgtgcttaagaaaatttatatgcccttaaaacgctggagccaaatgtatttttttggtctttttgttgggccatattcaaggaagtaatcttgaatggggaaacagaaaggctatgccctgggtgttaaagtatttcataatctctagaggagccatctggtttaagaaggcacattgaatgctataatatgctgtaatatatgagggaaacagactttttatactatcaagcctttcatgaaaaaatttcatgaaaaaataaacaaaatcattttagcttttaatcttggaactatatttagtataggagtgattcacaaatagcagagttactctcccattcgaaggggttatcagaatctctggaagacacattcacttttagtattaagtagagggagcttgaaattttgcaaggattttagggacaattctataagtgacataaatagaaaaaaccctccaaacttggtaaaataataaattatcccatggtgttgccattttaactttgatatctgtattaaaatgaaacttcagaactccaaacatatgtcaatattttatagcatgaaaccccaaggaagtctaactaatagatgttttacgtagggaaaaggtgaagactacaaactatttatttgcttggtttgtttgttttttgaagatcagtatactgcattgagcacactctacaaggggaaatattttcatgaaacctggttgcatttaataaaaacgtttatttcccacactgcagcccatgaccttccccagaaaatattccaatacgaaccaactgccttgataacagaacacaaacctcctaggactatagcaggactttgtgagaaagaaaaccattgcctctctctgaatccaatcaaaacctgaatgtactgtataaaaataaaccaaggtcatcattattccttgtcattgtgatttggcgtgccttcaaattatataccctgtatatttcaaataactgcaccgcctccattaactgagtttgacatcactttaatcaatgtatcttttcagaatgaaaggcagaaatgtcaaattcctaccattataaattcttttaactctctaatctgcattaaataaaaggttgtctttgagaaataataaatgctctaaagaaatataactagcatcaattttattttaaaatgtaactgggaaaagattaaatgtcaacacatctcttcatacagaggtgatttcccaagaaactattaaagccttacttacatgaggggcccctcccaaggctgtatccaattttctattatttttcttaaaatagcacccccaattgtataacctcaggccccataaatcctttcttcctggttcgttctgtgttgtcagacagggaatgtacattagtctcatttgtcaattccttaaaaaatgatgtgtgtttaaaatagaaaatttagaaaaatgaacagaaaattatctttaaagaaaggttaatttctaattagaccctcttaggaaactttataccctgtgatttgaatgcatataaatgtgcatatatataaatatatatactcataccaaaatactgtgtttcttgtatgtgtgatgaaataaagagttgatgaaaaagtatgataaatcatttttaataagttaggaaaatattacaatagaaggtggaaggagaaggaaagtttgggaaatgactttgttttactcttgagataaaattttgatgaaagataataaaatagaattttgaaaaacacctgatgtttccaagacaatgattttaatctcttttattaaactacacaagtggttaaaaacttgacaatttgtttcatatgtagcaaatgacatggagtacagggatttcaaatgaatgctataggaataaagaggaagctgtattaatatctgtgcccaaatgatgaatttgcaattcagtactgtctagctggaatagtgtcagccaacacctttttccccttaaataatgtaattatgcatagaacactttgtagtctttttttaaagtttagagtaacatctatatgacatactctattgtatttttcataatgttatgtcatgtaagatacaccaaaagctttgtattaacagtatatcatcaatttagatcagcaatctctttttcgtagttaagatgtctttaaaagattctgcagatgaaattctaaaaggtgattttattagacctcagatgacttacatcatttaaatatattcaaatgaaatgtctatttgcagtacactatttgaataattctttacaatgcattatttgagtaattctaaaagtgaacaatacaatatgtttgacaatacagtgatctcttttaaagggtaactgttttggttaaaaaacaacaaaacgtacttttgtaagtttatcaaactacggcaaatttacaaactggattcaaatgtcaaacatccaagtagcagtatgttgtcaaacagcaaaatttaatgtataatatagccctgagtatatctccgttttttcttaccaaactcattgtcatgttgcataggcattacttgatgattttttaaatgcagcgtgaaaaaatcctacagggcatgtcccaaaaagattacctttcttcgcattctaagaattgaaagttatttgaatatctatgacaaagcagagtgtagatttaccttgcttaatttcagcagaattgcatatattctttcaaaattgctctatatacttgtatatgatgttaattatgtagaatatatatatatataaaatcactagtgattttgatggtatttatgttacatatatcaaagaaataaaaacaaaaaataaaaatgtgtgtgtatattgcaaacaacagatatatgccatgcatatatttgtaatgatagtaaatataatagtttttcaatctaaaagtaataatgatgtccaccaaaagaaatttatgaagcaagccaacaatgtaagtaaatattgtattataaagtctggtagcttttaatgtgactcaatacatggacaatgttaacttatttccacaaagttttcccagtggcaaaacttctgcctttttttttagtagttgtggagcattacttatttggagagatttattttttcattcttaattataggcattgccctcatatctattttagaataactacactccacaagtcaaagatgggtggggaagagataaactcccatctcttcgggacacacagtccttatcatatattatttttactgttgtgccacagtccatttttaaatccttcattagtcatcatgactttcttaaaaataaacgaaatagttgtatttctatatgaaagacaaactaaaaaattgaactgaaaagctggctcataatagacatgaaacaacaaggtgactttactactaaatataattaggagttcctcaagtttgtatgtcgtttacccaagaaatcatctgatcatttgatagcatagatcacatcattatttgaaataattatcatgatatgctacagaaaagagcatttgaaatagtaaatgtgagtaagaaacattaaaattaaatctttatcaatacttttcacatccttcaattatccgtcccaactcattttattctttattttatccatgatgtgtcagagaaactttttctaacttttaggcctccatgtagttcctatacagtagttagttcaattgagaatatatgtcaggtcagtaacctttatgtaactgttactaaatacggaagtatcaactaatcaaaataataactcagatatacaaactatctcacagcaatcaaaataaatctgttatagtcaaatgacattctgcatattctattactgcagtggtttgttaatcaagaaatcatgtgtttagttctatcgcaaagaaaaacttttacactccatttctgttgaaaagttttcccaatgaaaaatatatattcctgaataaatacatatatatatgcagtatatataacatttatgcttctttgcaaactactgtgataatttaaaatcaatctacctaattagtgagcttgtcacaaactaaacgttatgccacagtaaaatatatttttagttactttgtacttacaacagtcctctacttcttcccaccaaagcattttgaaaagtgtatatcaaggcagcgataaaaaaaacctggtaaaagttcttcaaactttattgctccagtaggcttaaaaacaatgagaaaccaacaaacttcagcagctttaaaaaaagtaacacttcagtttttcctattcgtttttctccgaaggtaattgcctcccagatctgagtcctgtagggggaaagtgagtgatcccaacactgagtgagtcaacacagtaactgatgccaggattctgtagaggcccccggatatttcaaattccaggacctgcgcacaagcaagtgacccgccttctctctcaagttggtttcccataataggactgtccatggtcactacatataaggttgtgcttccagcatggcaagctctgtgaattcaaacaatgctcaactgtgttctgattaatatccaaaccagaatagcacagtggacatagtacttgcttttaaagccttctaaacacaaaaactattcagtacaaaagcataacaatactttctgtaactttcatgtgaatttattaacagagcagaaaatccggattcaaaattgacttttaaatgccttttttatcctctcaacaacaccaaaaatttcactctaccaaataaaaaggaatgcccagaataatccatgcatttgttatgtatccactgtctaccaaagttattttttccccttgggattcaatcaaaagttatgtattgatgatgccaacagtctgaataagagaagcagcagcagaatgcagcagctgaattctgaaggcagaatgtgtgtgtgtataggtctcatgggacatgttttcctgctaaaataaagaatactcttataatgcaggaaagaaatttttctcaaatcctaaatttcagttgtgaattatgctaaaacttctttactaacaaattattctttcttccatttctctggtgccaattcttaaaacaccatttttttagacattgagttaatgatcatttaatggttctgaatagaggcttgttttctgtattaagtgaatacagttgtattatgtcattcagcatgtaaatcattctttgccaatagaaagcttcttcatcttgttccttattacttttatgcaacaggcgagcccaaaattgatagaaaacattggaaacattttttaaagaaagatattctttttatagttataataatccctactaaaatttttgtttgagtgtttttattgtaccatttgttaaagtgacagactcatttttctatgtcaaacattcaactgcttgcgactgcaatgagtaatagataaaaattaaaaaaatattgagtcagactgtgatgtttaccttaatagttaattgtacattttgtgttttagaatattattgtcataacattgctattttccccagcaaaaggtgtatgagataaaacataaggcctaattttaatttaaaacattcttttccctaggtcacctcctttcctctcagtgtggttgtctaaatatgcatataagcaaaattttcataaaacaacatagaaaaaatgaaaaaattgttttggggctgatttggctctaagtctgcatgttagcatcagtgtccctctatgctgtgaggtacaatattgcccagagtataagtgccctttgtatcttgcactgtgagttttctacaaacataaacccttgtttaggccaaggcgtgaatacaacttgtcggtcccaaaccaacatcaatatcacgtgggaacttctgagaaatgcaagttgacacgagacctcaaaagtcagaaattctggggttgggacacagcactctgtgttttaccggtgattctaatgcatggtcaactttgagaaaccctaaagtgtatgtttctaaaaacaaccgtggttctaaatgtaacaaagatgtgtcctgggtaatgtctaaagcaccaaatcctgatagatctgaatgccctgagatacatttaattgccattcagccttagttgataatcagaatttatttggcacctataatgatttctgcattgtgtggaatgcatatacttcccttaagattttataatccaggtgcaaatatatgcttacaataactggaaaagtgaaaggcacgtaaaataaaatttagaccgaacaaattgaactccagttcagactgtgtcaccacagtactttcttgtgtcccttaatcacttatctttctcctttagtcctcagaataactacatcttgtaggtcttattagccccataataaaggaacttgctcaaatttccatttttaataactgtcacagaatttttaaaaatttattttaacttgttattttcaaatacttatagattcacaggaatttgcggggatagtatacagagatcccatgtacccttcacccagtttctcccaaagattaactacaataactacaattcagtatcctacaataactacaattcagtatcaaaaccaggaaactgacattgatatgtatacatatttctatttcatcactgatttgtgtaacctcaacctccacaaataaacacctgtttcatcaccacagagatttgcctcatgctacccctttacagtcacaacagtcaccctccctaaatatccctaaagcctggtaccaatcaatttgttctccatcactgtaattttgtcattttaagaatattagataaatgcaatgattcggtatgtaaccttttgagattggctttttttttttttttggcattctgtacttgagatccatttaagttgtcatcaatagcttatttccttttattgctgagtagtagttcatggcatggatgttctatagttactttattcacatactgtgggatattttcgttgtttccagggtttggtcactacaaataaagctgcaaaacaatcatgtagtttttcatttttcattcctctagattcatgtcccagagtgtggttataatttaccatataaattttagaataagtttatctacaaatagatctacagatctatctacagaatatctttcaggtagaattttgataggaattgcattaaaattatgaatacattttggaagaattgatgtttttaccgcattgattcctccaattcattaacatagtacatatgtccaatatttaggttatctttaatttatttcatcatactcggcttttttacacagtgctttgtgttgtgattagatatattaatatttctaatataatggcactactgtcggttatgcatgtgattgcacaaaaaaaggaaaacagcagagtttccaaaacccgttcttttcctgtttgtttttgctttttaagaaattttcatttaagagatggaggcttgctctgtcatccaggctggagtgtagcgacacaatcatacctcgttatagtctcaaactcctgggctcaagtgatcctcctgcctcaatcttctgagtagctgggtctacaggtgaatgccaccatattcagctaatttaatattttttttagagacagggtcttgttatgttgcgcaggctggtctttaacttctggcctcaagtaatcctcctgcctcagcctccccaggagctgggattataggcatgagccaccacactcggccagtttgtaaaaagaagcacatttaaaaatgtttacgttgttaaaaaatgttatatgcttgttggccgcttgtatgtcttctttcaagaagtgtctgttcaggccgggtgtgttagctcatgcctgtaattctattactttgagaagttgaggcaggcagatcgctttgagctcaggagttcaagaccagccagggcgacatggtgaaaccccatctctaaaaaaaatacagccgtgatgtcaggcgcctgtcatcacagccactcaggaggctgaggctggagaatcgcttgagcaggggaggtgaagtttgcagtgagccgagactgtgccactgcacttcagcctggactaagagcaagaccctatctcaaaaaaaaaaaaaaaagtgtctgttcatatactttgcccatttttaatgaatgtatttgtatttggtttgttgatttaagtttcttatagattctggatactaggcctttgtcagatgcatattttgtgaatattttctcccattcttcgtctgtttactttgttgatgtttcttttgctttgcagaagctctttggcttagtcaagttccacttgtcaatttttgtttttgttgcaatggcttttggggacttagtcataaattctttgccaagaccaatgtaaaaaagggtacttcctaggttttcttctaggattttttacagtatgaggtcttatatttaaacctttagttcaccgtcagttgatttttgtatataatgaaaagtagaggtccaatttcaatcttctgcatgtggccagccagttttcccagcaccatctattgaataggaagtcctttccccattgcttatttttgttgacttagtcaaagatcagatggttataggtgtgtcgctttgtttctgggttcactattctgttccattggtctatggtctgtttttgtaccagtaccatgctgtttgggttactgtaggcttatagtatagcttgaagtcaggtagtgtgatgcctcttgctttattcttttagcttaagattgctttggctctatgggctcttttggttccatacaaatttggattagtcttttctaatgaaaatgaaaaatgaaaattgacgttggtagtttgataagattagcactgaatctgtaaattgctttgggcagtatggccattttaacaatatttattcttccaatccaagagcatgaaatgttttgcatttatttgtgttgtctctgatttctttcagcagtgttttgtagttctccttgtatagttctttcacctccttggttagctgcatggtcatgaaaaagaatgaaatcatgtactttgcagcaagatgaatgcagctggaggccattatcctatgcaaattaacacaggaacagaaaaccaaataccgcatgttctcacttataaatgggagcaaaacactgagtacacagtggacataaagatgggaacaagagatactggggactactagagggggaatggagggaagcgggtgtgagctgaaaaactacctactgggtacaatgctcactacctgggtgactggatcatcagtaccccaaacctccacatcacacaatatgcccttgtaacaaactcctgaacatgtacccccgattcaaaatgaaagttgaaattattttgttaaaattttaatgaaattacaattgtttacagatgaattaattagacatacatttttcaaaaatataaagcataatttttattacagtgaactcatacacatttttttaaattacttttttttgtctacacttagatgatacatgttgtaaaatgaagactggcccatgattatattccaatattaaccagtcatccttgtgttattaaatagatggcatattaattagaaagaactgaatatggtaaacgtaaagtgaacaaggagttaattcttaaataattggaaaccctaaaggcattattttatattactttggaagtgcagggtcattttcccaacttgtttgattatttaatataattccaagcattatgattaatgcagcttcacaggacaaataagttgaagagaaacaggcttattaggtaatatacttatataaaattcacaaatttattgattagggaaaaaatcattatggatcatttctacttcctttttccacagtgatccatattggttgaaatgttacccatattataaggcatatatttcttaggtgtttaaaaaatctctttagttaagtccaatgggaaaatatgctagtttgtgagtgagtttataggcactaggaccagaaaaaataagacaaatagaattcaagcaatttggagggtgtccaaatagacaaaaatgtttcactgatgttttgataggaattgcattcaaactatagattagttttggaagaattgatatatttactatgttgtatcctccaattccattaatacagtatatatctccgtttatttaagtctttgcattatttccttagctttttagtttgtagtatatagatctggtaaatgttttattagattcataagtatttcattgtttcagagtgactgcaagatactatgtgaaaaattttgggtttcagtagttaattgcttgtatacaaaaatacaattaatttttaataatcattttactgtgataagatttaatatgagatctacccaacgaacagattcttaaattataatgctgtattgttacatatagatacgatgttgtacagcagatctctagaacttattcatcttatataaatgaaacttcatattcattgattagcaattgacttttataagttgatcttgtatcctaagaccttaacaaactcatcatttctaagagtaactttgtagaatacctgggattttacatagatcatcataacatctgcaaatggagacagtataacttttccttcctgatttgtacgcttttatccacttttcttgcatttttacactagctagaacttccagtactatgaataatagtagggctgaaagcaaccgtctttgccttaatcctaatattaggaagaaaggtgtaaattctttcattattattacaatgttagctataagatttctgtagttattcttttccaagttgaggacgttctcctccattgttagttttctgagagcttttatcataaatggggcactgaattttgtcaaacgttttttcccctccatcaattgatatgatcaagtgattattcttctttagcttcttaatataatgtgtaaaaatttgttaaggctttttgtctctatatccatgagttttattggtctgtaatttgttgactcttctactgtgcttacctggttttattatcaaaatacttcttcctcataaagtacatttggaagtgttgcctcctcttctattttctggaagttgacagttctctcctttcatcacttgaaaaatgtcatacttcttccttcgggctttcatggtttcacataagaaatcctctgccatttgaacttttttgcctatagataaagtgtctttttctctttcactgtttttaagactttttttaaaaaaaaaatataactagttttcagacatttgactatgatgcgtctaagcatgagtttctttgggtttatcctgtatactcagctccttgaatctgtagggttttgcattttacaaaatttggtatttttcaatcattatgtgcttgagtacttgttcaacaacaccctccctttttgaaactctgatggcataaaccgtagatcttttattataatcccataggacaactgagaatattttcattttaaaaatcgtttttttccttcttgttacgactgtgtaatttctattgtcctatctttctgcacacagatttcccctgtctcctcacctccattctactgttgagaccatttattgaacttttttttgattacgatatttttagttctaaaatgtcatgtcgttctatgtcttctatttctttctgacttttcccattttttatttgttgcaaaatgttttaaaaagcttactcaacaattttcgggatggctactttaatatccttgctagataattctgtcatctttgtcatgtcagtataagtgactactatctttttgcattccagttgagattttcttttttggcatttgggatattacattatcagactctggatcttatttaaatctattttagctcgtccccttctgactgttctggtggaagatagaggtagaagtgtgctgccttattgccaggtgggagtgaaggtcctggttccccactccatctatggttgatactttagagattattgtgtgtgtgtgtgtgtgtgtgtgtgtgtgtgtgtgtgtgtgtgtgtgttctgtaaataaattttacttgacaccatcttaattccctttaaaattagtaagtagatatctggaaccttgtgagttcatttttaaatgttcagatttttttttccactggacaaaaaaaaaaaaagagctttaactcacatttccatagacaatgaagcccatggcattcacataacgatgtgatttcaggacttggtactacatatcagtactatctatagagtcaagaaagaaaacatttgcttaccaaatataagcaaaactcaaaactaatttgcctgtgttgtgaaaataatgactcctcactttgtggattgattcccaactgttttatgaggtaaatgtacagggattaatgaagatttttaaagatttctgaatgtaagaaaggtattatgagtacaaagatagtaaatgcattgatgctagtgagctgagaatcagtaacatgttttaatagttgtatctcttatggggtattagtgaagatcctggtaggaaatataggtagcagattcaaaagcatttaacagataataattcggtgaaagaactatggacaaacatataggcaggctgatgagaacaaataagggatggtgagtcacctagcaagcagcaagagaggtaatttgtttctacctccaggcctaatatgtcaaggtaaaggaataatgttggaatagcaatagaaaagggcagtcactaccaggaccttagtgaggcatatgtgaagtggaacacaaatatccaaacctttttttcccttgccctctgatgtccagctggtgtcacataatttcctaaaagttagtgcacaagaggcgttggtgatacaaatgaagagacaagctttccagggcaaaaaacagggcagagaattgcaaaatgggtgtggtagcgaggagtggagccactgccactaatacaactgaagaatttttagcaagcaggctcacccctaccatttcagtcttggatggatactcagtactagtgtgataccttgtagaaaatatgatcaaggatgaatagatcctacgcaatgtagcctttgccttcattttcaaccctacatctctgaacttccttgagttatgttatgtgctttcctactattatatctcagattatttaaaaaattcatcatacatgttttctgagcatgcagctttactccctttttgcatgtgtgataaataaattgggtgtatgtttaaggtgtttcttacctgatggaaggcaagctccatcaaaacagttgtgtcttcctttttagttgctttatcactattgcttgtcattttgttgtgtgaataaaattgtctccacttgcaatttctttgtattatatcctttgtgtattatatgctccctcattcttctgggctttgtttaaatttactttatgaagattattttttttagcttctcctcactcccactcatagatgggtctaacaatatgaatgcatctttactactcagctgtaaacttcttgatattaagaattaattgctatttatattatgttgataactttagctctcaaaagcacattgggtgtaataggagtttagtgatatcagttggaaaaaaggaaacaggcaagagagggaaataaagaaatttatgatccagatcatcataaaatttaaaataaactttgaatgtttgagagtagcaaaccaaatctctttgagagtgtatgctaaaagaaattatgaaccttggtactatgggatgaccatagtgacaaattctcatttaaaacaatggaactgggccgtggaataaatgtgtatttatttatgaaacatttattagggccagattttctgcattaaagatatgagctaacaacttcaggtccctgccctcaaatagattataccttgggtatattaaaagaaaagttgacattttaatcgacctgctaattgataaacttcaataagcttgaagactttcgtctcagagaggtacctaatagcaagaccaggttttaaagataacaccgtatgcactgcctactataaaatattgtcatttaggttaaattaagcattgcgttttaaaaagctgctcccaaacgcatacactagacaagatgaaaagtctcagatcaataatcaaagttctcatctcaagaagaaaataataaagagtaaaaactaatcaaaataaaaacagaaaaacagtaaagaagattcattaacaaagagctattttttcaaaacggtcaataaaattgacaatgtgctaaaagtgacaaagaaaaaattgagaggacacaagttacccgtatcagaaatgaagtagggaatattactacaggcctggaaaatacaaagaaaaaaaaagacagtaagggtttactatgaacaattcttcacataagtatttaataatttagatgaaatagattgattcttcaaaaggcacaaactactgtaaatcaatgaatataaaatggataatttgaatggcctagactttggctatttaatagtaatttggatatactagataatgagtataactgttaaggaaatataactcataatttaaaaacttctacaaaagcaaacttctataactgcattggaaaagtatgccaatcttgtgaagaattaacaccaattctacacattcttttccagaacatggaagggaagaaaacaattctgagtatatgtgttgagtccagcaatagcctgatacccaaaccagaaaaacagtacaaaagaagaaaactataaatccatattccttacaaatattaatggaaaatttattaatacaatttcagcacataaaattcagcaatgtactaatggatcacttggggtttatttccaggatgtaaatctggcttgatatttgaaaattagtcactacaatctaccatattaacaggtcatagaggaaaaatcacacgatgttatcagtaaatgtactaaaagcatttgacaaactgatatatctaatcttgaaacaacctgtctgaaaaataggactaaaggagaatttcctcaacttaataaacaacatctacataaacctacagctaacttcatacttaatagtgaagtattaaatgctttccccttaatattgtgaacaaggcgtgaatgcacacgctcaccactcttattcacgtactgctacaagttctagccagtgcaatgaggcaagacaattaaatcaatccatacagatgggaaaggaagacataaaattgtcccttatatgtagatggcatgaaaataaaattttcaagctatctataaataatctcctagaaattattgataagtgaattcatcaaggtagcaggatgcaagataaatatacaaaaattgattgtaaccatttacattagcacctcccacaaatgaaattcttagatctaaaactagcaaaatacataccatatctatatgaggaaaactgcaaccctctgatgaaagaaatcatagaagataatccatattcatggatgggaaggctcaatatttttattatgtcagttattctcaaattgatctatagactcaatgtaatcccaatcaaaatctcagtagttactttgcagatattaacaaagagattctaaaaatgatatggaaaggcaagaaaccttgaatagccaaaacaacattgaagggctgggcgtggtggctcacacctgtaatcccagcactttgggaggccaaggtgggcagatcacttgaggtcaggagtatgagaccagcctggccaacatcatgaagccccgtctgtactaaaaacaacaaaaattagctgggagtggtggcacacgcctgtaatcccagctacttgagaggctgaaatgaaagaatcgcttgaacccaggaggcggagattgcagtgagccgagatcatgccattgcactccagcctgggtgacagagagagggagactccatctcaaacaaacaaacaaacaaacaaaaacaatattgaaggacaagcacaaagtcagaagattgagactgctctacttcaagacttcggtaatcaagacagtgtcttattggcaaaagaagagatcaatggaacagaatagagagcccaggaataaacccacataaatatagtcaactgactgatgtttgataacggagcaaagacaaccttttcaataaatggtgctggaacaactgggcatccacatgcaaacacctttcacaaacattaactcaaaatggatcagaaacttaaatgtaaaatgcaaaactataaagcccacagaagataacataggagaaaatctatatgggtctggtgatgactttttagatataacaccaaagacatgacctatgcaagaaataattgataagcaggacttcattaatattgaaaaattctatgctgcaaaagacattgtcaaaagaatgtaaagacaagccacagaataggagagaatatttgcaaaagacatatcaggtaatggactgttatccaaaatatacaaagaactgttaaaaatcaacaataagaaaacaaacaactctattttaaaaatgggcaaaacaccttaacagataactcaccaaagaagatatacagatggaaaacaggcgtatgaaaagacgcttcacatcatatgtcatcaggaaattgcaaattaaaacaacaatgtgatgctactacatacctcttagaatggtcaacactcagaacagtgacaccacccaatgctggtgaggatatggagtaataggaactcttgttcattgcttgtgagaatgtaaacttgtacaaccactgaaaatcagtttaaggattttttacaaaactaaacatactcttgctatatgatcaagtaattagactctttggtatttacccaaataagctgaaaacttatgtccgcacaaaaacctgcagatggatgtttatagcagctttattcataattgcctgaacttggaaacaacaagatgttcttcagtaggtgaatggataaataaactggtacattcagactatagatgctaaaaagaaatgagctatcaagacatgaaaatacactaaggaaacttaaatgcctgtttctaactgaaggaagccaatctgaaaatgcttctatatactgtaggattccaactatatgacatccaggaaaggtaaaattatgaagatagtaaaaatatcagtggttgccaggggttagttggcagggaggcatgactaggcagagcacaaatattttaggtcagtgaaactactctgtatgatattatcatagtagatacacatcactataaatttgtccaaacacacagaaaacacaacaacaagagtaaactctaatggaacctatggatctgagttataatgatgtgttgacgtaggttcatttattgtaacgaatgtaccactctggtgagagttattaataatgacagaggccatgctcgtgcgggcacaatgggtagatgggaaatctctgtctttcaattttgctgtgaacctaaaggttctccaaaaataaagtctattaacaatcacttgcattctgtgaattaataatgaacatatggacatggaaatttaaaatatagtatattttactatgtcacaaaaattaaatataaatctaacaagccatgtacttacatggtgaaagcaaaaaaaagttttagaagtaaatcatagaacatctaaattaatgaagaaatatattgtgctcgtggattgagagattcaacacagtaatgtcaattttacccaaactgttacacagtttacacaatttttatcaaaatctcagcaatatttttggaatttaggtgtaggaaaaatttatgtgaaaaggcactctaaaatttatgtgaaaaggcaatggatttagaatagctaaaacaatgttgaaaaggaagaatgaagtaagaggaataagtctaccagactgaagacttattaaatagctacagtaatcaagatagtgtggtgttggtgttgggatagacacgcagattaatggaacagaatagagacttcagaaatagacccacacaaattgctcaactgattttgacacagtgcaaaataattcagtggagcaaagatagtcttttcaacacatgggtcttagaacaagtggacaaaaataatggaaagaaaaaagaagaaaaagaaccttgacataactttacaccttatgcaaaataaaatgcaaatagatgatgaatttaaatgtgaaacacaaaataataaatattttacaaaaacatacaggagagtcttcaggatgaaaggctaggaggagttcttagatttgacgttaaaatcgtgtgccttaaaagacacaatttgataaatttgacatacaaaattttaaaattttgctctgagaaagatgctgccaagaggatgaagagacaggctgcacatcgagaaaaatacctgcaaaccatatatctgaccatgcactagtatctagactaaatgaagaattcatgtaacccaaaagtaaaaacaaaatagacacaaaaaaatccattagaaaaatgggcaaaagacatggagacatttcaccaaagacaacacatagatggcggataagcttgtgaaaagatgttcagcatcattggctcttagggaaattcgaattaaaacctcaatacgatataactctgtgcatattagaatggctaagttaaaaaatagtgacaacatcaaacactggcaagaatgcagagaaatgagatcacttacacattgttggtggaaacatgagatggtaaaggtactctgtaaaagtttggtgcattgtaaaaaactaaacatacaactaacctacagcccagaaatttcattccatggcattaatcccagataaatgaaaatttgctcataaaaaaactgtacatgagtcttcatagcagctgtatttgtaataggcagaaactggaaacaacccagatgtccttcaacaggcaaatggttaatcaaactggcatattcataccatggaatactactcagcagtacaaaggaacacattgttgatgcacattacaaatctggaagaatctccagagaattatgctgagtgaacaaggctagtcctaaatagctacataatacagggtttcatttacataacacttttgagatgataaaattatacaaatagagatcatattagtagttgctagagattaaggagtgcctgagggcaggaaaaaagtgggtctgaccatgaaagggcaacatgagtgatccttgtggtgatggaaatatcctgtattttatctgtgctgatgtcaatatcttgttgtaatattgttctatagttctgtgactttaccttaaggagggactgggtaaaatggcacacaggatctttctgtattatttcttacaactgcatgtgaatttacagttatctatctatcttttttttttaaaagacagtgggctgggtttagcctatgagccaaagtttacagactcctgccatacgacactgacattcgtgcatacaaataaatataagataaaactacattgtgaagcctgatggagattaggtggcatcaatgtcatgtttaacactgttgcacttgcttttttttgttaaaaggatactgcaactagattatataacgtaacacacttaaaagaattatctaattcaggaaaattttaaatatgcaaatcagaattctgggtatcgtttaaataaaatatttagagtcttgtaaaaacaggctctcagtgccattgtgttattgttaatactcaaaactgtttcataagtttatttattgaaagcctagaccaagttattactacacaagaaagagtaaagaaaacaatataaatctatgtggatgacattttagagtgcaacttcagcaaacttgtaggctcaaattaaaatcctttcctaatttctttctttaaaaaagcaaaagaaaaaaatcccctccctgttagaattatttttttactctgttcttaaaaccaccatttttttccatggcaaggctaagttttcatcctgataaggtttttctgaaggtttaatgtgtcatcctaagaaacaattggtaagaattgataagaacagaagatccaacgattgcggtgcctaaagctcgaggctattcttagttgtgcatatttttcgagcacgtgattatatgaaagttctgcacatatttttgaagacttctatgaaataaaggggcccaaaagcttaagcttcatttgcttcctgacaactcaaatcatctggaaaggagagaagctttgagaggatttatgtagcagatgaagctgcacatgctattttctctaatagtttttaaagagagagagagagagagagagagtctttgagtggcatcctgttttgaatacctcactacagaatgccttaaaaagaaatggaaagaaaacacaaataaacaccatttataatttggttcaaaattttctgagccccacaatgaatatacttactcactgaagcctgagagtcagagcctgttaatggaaatcagagaaaatatttgattcgaatttaaatgaggtttcacaaatggattgaatttagaggaggataaaaaaagttttatattggtttatgtctcaaaattctgttcagttttataaaatgtttaaacattgtgaagtctggttatttgaaagatagcttttaatctatagtatattaaagattagtgcttaaagtatattctgggtttaatagatgtctaaacaacctaaacaacctaaagcatttatatttccttaaacatttttaaaatattgaaaatcttatggtgaatctttagagttaactttatttggaatattgagaagtatgatgttattgaacccaagtttaatatgttattgaacccaagtttaagtgtgtgtgtgtgtgtgtgtgtgtgtgtgtgtgtaggcatatgctttttccatcacaaattatcttccaaggtacatgtctctctctccacgttagcaaatgaggtacatttaagggttttcatattctgaggtaataccttcaggaacttggagaagagagtaagattagaaatagtttaaaatctctatatttaaaataaaaaggggagggacttggagaagggctacttcgataaaacctcagtatgaaaacggggaaatctgagagtacaattggctcctagaaggttggttagcaaaaatataatacatttttaaatagaagcaatgataagagcagcagttaaatacattagaaaagataaagtatattaggctatcaggctctcacttccacctatattccccatttaaaaaaatttttcttcagctttttttttttttgagacagggtctcactctgttgcccaggctggagtggtaaacatacacagtgtttgtttatttttaacaaactgccaaactattttccagactgatattcttttcagtaatgtacgagtgatcccatttctccacatttttgctagttatttggtggtagtgtcactattttttatttcagacactctgaaaaatgtgtagttttatctcactgtggtttcaatttatatttgcttgatgtctagtgatatttaatatcttttccatatgtttgtcatttatatatactattcagtaaaatgtctcttcgtgcctttggctcatttcctaattaatttatttttggatttttgcttttgagttttctaagttcttcgtatatagtccctgtttttgcaactgatatgcaaatattttctcccattctgtaccttgtatttcacttcttaagaggatccttttcagatcaaaagttttaattttaacgaagtccaatttatcagtttttcttttttatggattgtgctatttgtgtaaagtgtaaaaagtctttgcctcagtcacaaaattttctcccatatgtttttctaaaatatttgtagttttatgttttatatttgacatttgagataattttgcataagacttaagttgaggctctatttatttacttatatatttatgggtgggctttgtttgttttgcctttagatgtctacttgctcaaacaccactcacttagaaaaaacgcacactatttgttgaaaaggctatagaaatggaaaggctgttaaaattcctccttggaattgctttcacaactttttaaaaaatgagtttgcacatatttgtgcgggtctatttctggaatctctattctattgcattgaactatgcgtctatctctcccccaattccacactgtcttgattactgtagctacataataagccttaatatttagtggagtgattctttccactttattcttctttgtcaagattgtattagctattatcaggcttgtacttttccgtataaatttagaataagctgatccaagtctactaaaaagaccttgctggtattttagtagaaatggcattaaaactatagattaatttggagataattgacatctttaccatgttgagtattccaatccattagcagagtatatctctccatttataagttaattttttatcatgctgtgtttttcaacagtgttttgcattgagattagactgtgttttcatatttctaatatacttacaatgtgctattgtctgctatgcatgtgattacacaaagattgcgaacatagcaaaaggtctaaaattatgatttagaaaagaaagcagattttaaaaacctaaacgactatagctaaatatacaccatatgtgtatgatgttgaaataattttaagtaataagattataattgtttatagagggattgatagagacctgtaatttttcatgaatgcaaaatatattttaattacattaaagtcatgcatcagagtgttttttaattacttttctttagcctacagttttatgatacatgttgtaaaatgaagactggtccttgcttatattgcagtattaacctgtatcataaaacagatgacaaactcttagaactaagagcactaaatttaaaagtgaacaagaaatgaattcttaagtatcttaaaaccctaaaggcatttttaaaaataaatatatattttatttcatcatacattgtggatgtagagtcattggtgagaaatatatcccctgcattataacaatataattattggaaagtataatattcttttaatatctaattcaacatggaataatagattttcagcaaaaggagggagttgcatatatctgacctttattgacaggcctttttgtctccagtaattacccaatctctatgcgattcagtgttcttaaggaaatccaacttttcttgctcttaattatttgtttccacaaaatactagccaaacacatagctattaggtctatgtgaggtggacgtatacatcaaaatttcttcacagccacttaaccaacgtgctaagttttccagaatccaaaacaaatcagtttaagaggtaggtatgcaaagaccctgtaatactctagattttaaaaaagtatccttagttaagtaccatgagaaaatgagctagtttatgtgctatgttaggaacataatagccaaaaaaaaaaaaaaataaataacagttggaatcaggcaccttggtacttcatgagtattttgcaacagtataatagggcctttcagtaatgatgtgcttgcatagaaatacatgaaaattacacaaatttgatatttttagtaactgaatttagtttagttttgtaaactcagaactcaagggtgacgtgcatatgtgcgtggagtgacttacacatacatacacaagcaatcatatgtacaacttgggctcttagaaagtagggcacattgtcaccagttgaattgtcatatgattcctgatttaaatgataagtcgttccaatttcttcaacccttacttcttgagcgaacagtccatatgcaaatcagtatggagtggcaaactttaatctcacgttctagtgagtattttatactaaaaaccaccagatagagtcatgaaaagtagaaattgtttatatatacacaaacgcattttcttaaagtaactatgagtttcatttactttcatcttatactttgttacttcaaagggagaagttactgatttttcttatctccctttatcagccatgtccctggcaagaaatagaattcaacatggatggttcaataaaacagtacaaaggaactactttcagaggtgtgaatgggcttaaagaaaccaaaaggggctatcgaggcacctagagacaacctccagtaggcaattgtgatatacctttcccagccttaccatgcctgaagagtcaagtgaaggaagtaggattttctaaatccagtaagagatagagccatagaggagattcttaacaggatagttagagatataagctgccatggtgggaaataaggcacaaagagagtggaggtcaatgtaaaaggaatgtcccagatctgctctctttctgcctttctgtcttatgtttatgccttccattggccaaaaccaacaggagactactcggcaagggagctaaggaaatgcaatttataggggtcagcttcacagtgacagagcagaacaaaaaagagcataaaatggattgggccaagccagcaagaaaagagtgtactgaaatatttaaaatttagagagaaaaaataaatccaccaacctaaaatgctgtattggtgaaattatccttcaaaagtaaaagagaaatgaatactttatcagacaaacacgctgagggaatttgctgccagtagatctgccttgcaagaaatgtcaaaagaaggacttcagagaaaaagaaaatgatgtaagtcagaaacttagatctacataaagaaaggaagtacattagagaaggaaaaaatgaaagtaaaacaaaattatctattcttcctattcctgattgatctaataaatatttgttcaatataataacagcaagaagaaacattggatgattagagcttatggataagagaaacgaatgccagtaatgttacaaaggttcaagaaggaagagttgggaatattctgtgtgggaaaaaacggattggagtgggagcagaaaaacaaaaatcacaattcctttacgtaaattaacatcagaaccatcctctaattaggagttcaagttcaacttcacttggttgtaatcataatttcaattctttctcttcttaaaagctaaaggagccaggtgcggagtctcacacctgtaatcctagcactttgggaggccgagaggggcagatcacttgaggtcaggagtttgagaccagcatggtcaacatgttgaaaccccttctctactaaaaatacaaaaaattagccgagcatggtggcgggcgcctgcagtcccagctactcaagagactgaggcatgagaatcgcttaaacccagcaggtggaggctgcattttaattatttattcatctgatgatggacagaatctaaaaaagttgaactcatagaaatacagattagaatgaagattaccacagaaatggcggaagggtcctaccgggaaaagaaagatgttgatcaaagggtacgaatttttagttaggtaggaggaagaagctttagtgatctattgtacatgatggtgactataatatatcataatgcatcatatatttcaaaattgctgaaatagtggattttaatattttcaccacaaaaaaaatatgaggtaacagattcattaacctgatttaatcactctgcattgtaagcatatatcaaagcaccatattgtaacctataaatacaaacaaatattaattgtcaatgaaaaagaaatttaaaaataaacgacaacatcaatacgacatatgagactaccattatagtccaaaaagtgcactcctgggcatttatcccagagaaatgaagacttatgttcacacaaatcctgtacattagggttcacagcaattttattagtaacagccccacactgtaaacaacaatatctctcagtcagtgaatggtgaaactgtaggatgtccacaaccataaataaatcagcaacatatattagtaataaaaagtaacaaactattgcaatatgcaacaatttagatggatcattaagcaattatgctggctgaaaaaagctagttcgaaaggattaaataccatacaattctatttgcataatattcttgaaatgacaaaattatagacatgaagaacagattaatggttgccacatgttaggcatgggacagggtgacaagaggaagcttgatgattttattaaaggtcaacaggagagatctttgtggtcatgtaacatccgtattttgactgtcgtggtggacgcactaatctacatgtgtaaaaattgcatttaactaaatatatacacacacatgagtataggtaaaactgggaaaatctgaattagagaggttaattgtaacaaaatcctcattataatgtttgaatataatttgcaagatattacaattggggataaccgagcaaaagccacacaggatatttcacataggatcttttatattattttttacaactgttcttaactctacaactctttgaaaataaaatgtttaacttttaaaaagtttctcaagcttgcttagcttgtgtcagagcttggattccaatgcagatatgaagccagagcccttgcttcctgtcattgctctataccggtcctcagagttcccaggacgcaggaaggtagattggaattgcactgcaggcacaatttaaccaccataacagatatcctaaattatttttttatttttaatttttgtgagtacacaatagatgtacatatttagcggtacataaattctaagctaccaatagattttagatcatatggtcttgtaaaatagtatgagcatgcaacggttaggatcatgctgccaacctctaccacttaatagatgggtgtgtgtgtgtgtttgtgtgtgcgtctatgtgtgtgtgtgtctgtgtgtatttgtgaatgtgtgacaccttggagaagaaaatttttcacacctcagtttccccaattgttaaatgagggataacaactgttgctaactcactgagttacaaatgacttaatatcgacaatgcacttagaataccacccagaacatactaagttgtatgtgttagatattattattactactactgattgcagaaatgataaaatatgaaaaatgttcttttagaagaaatgtggcaaacacactgacatgattcaatgaacagcagtctagattatgtatattgtcttataattttatcatctacgtgacctaagtattagccaccgctgccattccaagagtcgattttttgtaaaattctgggaaaagagattttgcttctcacatttactcctaagtcagaagtctattgggtaatcacttctctgggtttagatccctcctggccactctcagtgattctttcgcccaggccactgttcgctaagcttgtcaccacatggatttactggacaattgtccatttactggacaatggctcttcctagtgtgctgctgcccctcagcatgggcttcagccccacaccaaacatggaacaggctctcctcctgttactactcacccttatagtccccacaactccatcagagagttctgtaggaatactggcctttactggagggttgggattgggggtaactaagagaattacgttaagggatggagaaaggccaaactctatactaacaatggcttggtcttgtgttgtgtagcagaaaagcaggaaaaaattaacccctacacaacgttttttgtgagcacgcaccagttcctattcttactctttcctattgaaggctatgggcttcctttctaaaaggcctccattttcaagctagaaatgactgccttccttcagggaaattccaccccataataggaaacattgatcatttactatatgccaagtattgatctaagcaactcatcagaattaactactgtatttaattgattctgagatgacatttcacattttaacatttctaaaatcaatatgtcttaaaatcattagtgtatagcgtttaggggtatcctgttttttaatttgttagtcctacacacaacaatggtctatcttgcaatttattatttcttagattcaatgacatacagcaatatagttttcacaacagtttaatcatttagggacttattttatcaacattttatagatgtcacaatcgagtctcagaggtgatacacacctagcaacctcaaggttgctcaaggtcacacagctagtcaatggtagatttaatcccagatagcctgatccaagagcctgtacccttagaatataatctgctcctcccagattagcgccatctcccatgggtccccattaattagcaaggacagcctaatctaattcatagtgaggaagagaaacattttccaaagtttgcaaaacttgccaagctggccaacttatattattattattattattatttttttttttttttatgagacggaatctggctcagtcgtccaggctggagtgcagtggcgcgatctcggctcactgcaagctccgcctcccgggttcatgccattctcctgcctctgcctcctgagtagctgggaccacaggcacctgccaccacgcccggctaatttttttgtatttttagtagagatggggtttcaccttgttagccaggatggtctcgatctcatgacctcgtgatccgcccgcctcggcctcccaaagtgctgggattacaggtgtgagccactgcgcctgtccgttatagtattaagcaaaacgagtgccaatatttggcttctccttcctttttttttttctttttttttgacaaagtttccctcttgtcacctaggctggagtgcaatggcgcgatctcggctcactgcaacctcagccttccaggttctagtgattctcctgcctcagcctctcaagtagctgggattacaggcatgcaccaccacacccagctaattgttgtatttttagtacagatggggtttcaccatgttggccaggctggtcttgaactcctgatctcaagtgacccacccaacttggcctcccaaacttctgggattacaggtgtgagccaccgcgtccggactctccttcctctttcaagttgtttcctgggtgtggggtgtggtggggaacagaggcgtaaatagcaggtcctttacagaaccacctaccacaaagatgactacactttgcctacacaaaaagctggcagaagctttttgctttattttggaggccttatcaaacaccagggcagaatgatctgtaatctctgaggtgagaagctagtgaggattaaccacttttctctcctagcaaaaactcccaaatggtgaggctagtggggaaggaccgggtggtagtgttattgttcttccagttacatgtatttgtaatattattcaatgtaccttatctattaattatgtatattttatcagctcattccccatccaactgtgacagagggaagtgtgacacaagaagtagtgattaaatatctcaacatgttcatgcatccagcgagcaaaaacccagactactttgaagtaaggatagactatgtcagccccattaccaaatatttgagggaaacggttgtacaatataaaaccatttctgaattttagaggagtcaaatataaggtttccaaataatataaaacgcacgccattggtttcctccctccctccctccccttcctccctccttccctcccttcctcccttccttccctccctccctccctctttctttttctttctctcttttttttttgaaatggagtttcactcttgttgcccaggctggagtacaatggcgcgatctcggctcactgcaacctgtgccttccaggttcaagcgattcttctgcctcagcctcccaagtagctgagattacaggcgtgtgccaccacgcccggctaattttgtatttttttagtagagacagagtttcaccatgttggtcaggctggacttgaactcctgacctcaagtgatccactcaccttggcttcccaaaatgctgggattacaggcacgagccacagtgccccgccagttatctttctttggctacacctttttgaggtaggactttcataccactgggcaatagcaactgaatataggaatgaacttaatatttctcatacatgaagattatggcatttcatttctatttgtgaagtgggcacggatatattaaaaatatagaaaaccttactgttctcatttaaaattttttcacgatatacatcacatttcatacaaaatgaaaatatgtattgctcgattttgatatatcttgtacttgattgtcaattaaaatgaattaatttttgtattgaaaaatttagtaataaaaactgagaatgtgaactacacacccatatacgtgcacaacaaaagcttaacatggtatctataataagcctacagagttcttttaaactaaacataatagttgccaaaagggattcatagcttttgaattgatttaaaattaacctccctgtcacttccaaatgaatttccatttatgtaacataaaattgtcccatgacaaaactttcagccggaatacatttattccttcttgagtctatcatttgcaaagcactatggtgtgccacttggaaagggatctaaattagaatttttcccaaaagccataaccaggtatatgacatgcagcattttaaagggtactcttgaattcattttgatgcctgtactcacttgagcacatatgttttacaactttgaagacctccctctcttagctgggttctagctcacacaatgctccagcattgaagatgttgaaaaaagatgtgtctgaatattcacacacacacaagtgataatacctacataatactgggttgatggtttattaaaacacaagaagcatctaaactgccccacaaatatcatgcatatttagaaataccagattcattttgcatatcttgtggattccttatacagcaccctctctcccccctgtttgtgtgtgtatgtgtgtgtgtgttaatgtgtgtgtctgtgtgtagatgtgtagaaggaatctagtatttctaaattcacatgataattgtggggcattttagatgctttttgtgattgaataaaccattaacacagtattgtgtaagtagaattattcacattttgcagataagaaaactgagatttagtaagttttttgtccaaagctataaccgagattttaaagtcctgtgacgttaaaccctaaaacatatgcttttagtatcataatctttaccatggttaccagatgacatgttaaaaatctgctaagtaaaggataggacaccaataacccaaattattaaatgctatctaggtttaagtgagggcttccatcaatactgagaaaactttgcctgcatgcacccttgctacttaccaattaacagcatcgccgttatatatgagcttgttaagtaagatgttgaatactggccgggtgtggtggctcacacttgtaatcccagaactttgggaggctgagggggttagatcacttgaggtcaggagttcgagaccagcctggccaacatggtgaaacaccgtctctactaaaaatacaaaaattagctgggtgtggtggtgggcgcctgtaatcccagctactctgggggctgaggcaggagaatcacttgaaccccggaggtggaggttgcagtgagccgagatcccaccactgcactccagccaccactgaactccagcctgggtgacagagcaagactctgtctccaaaaaaaaaaaaaaaaaaaaaaaaaaatgtcgaatgtcaggcacattccaaacctactgaaacagactctaaaatttaacaagaaccccagattatttagacacagttatgtatgcaacagctatattctacaggtgtaacaagaaacaaagctaaggaccaatctaaacatttcctaaggaaaaaaaaggagggcaatacctttacttattcctttattactttcaaaaagattttataatgatttgctaaattctgttcgccctgatcagataatatgtctgcatctaagttaaaaaaatccagaatcaaaatcaaacttgtaaaattcttgttttcaagcttattttttaaatgaacatagagaattgtatgtatttattgtgttcaacatgatggtttgaagtacatatacattgtgatatggttaaatctagctaattaacaaatgcattccctcacatgttatcatttaacatccactctcttagtatttttcatttgaaaaaaattaggttgagcatccctaatccaaaaatacacactctgaaatgctccaaaatctgaaactttttgagcactgaaatgatgtcatacgtggaaaattggacatataagtatttaatgcaaactttttttcaagcacaaaactgctaaaaatactgtataaaattacctcaaagttacgtgtataaagtgcaggaaaacataagtgaatttgtgtttagtcttgggtcccatgcccaagataccttattatgtatatgtaagcattccataaaatcccaaatctgaaacacttcaggtcccaagcattttggataaggaatactcaatccgtatcatcattaactatagtcaccatattgtacaatagatctcttgattttatttctcatatctaactgtaaatatgtattatttaaccgttatcttcataatcctccctctctcttaactacctcaccttctggtaaccaacattttattctctactttaaaatcaaccttttcagattccgcataaagtaagataacgtggtattttttctttctctgcctggcttatttaacttaatatcctccaggttcattcatgttgctgcaaatggcaggtttcattctcttcatggatgaacagtattctattgtgtacgtataccacattttttcttttattcattcaccagttgatggacccttaggttgattccatatctcagcaattgtgaatgtgctgcaataaacttgggtgtgcagatatctcttcaacgtgttgatttcatttcctttcggtatatagccagtagtgggactgctggatcatatgttagttctagttttaatttttttgagaaagcccctactgttttcaataatggttatattaattcacattcccaccaacggtgtgcaagggttcccttttctctaccttctcaggaacacttgttatcttttgccttcttgatgtcattctaacaggtttgagttgatatctcactgtggatttatttacatttacctgatgtttaatgatgctgaacatgttttcgtattcctgttggctatgtgaatgtcttctcttgagaaatgcctgctcagatcttttgctcatttttaattgggttatttgttttcttgctatttatttgtttgagttactgatctattttggctactaaccccttataagatgtatggtgtacaaatatttcatcccattctgtaggttttctcttcactctgttgattctttcctttactgtgcagaactttttgagtttgatgtaatcccatttgtctatatttggttttgtttcctgtgcttttgaggtcatatccagaaaatttttgcccagatcatagtcatggagacttcccttatgtttccttctggtagtcttatagtttcaggtcttacgtttatgcctttaatccattatgagttaatttttgtacatggtctgatataagggtctaattttttctgcatgtggatatctattttttccagcaccatttattgagaagattgttcttttcgcattggatatacctggtaccattgttgaaaatcagctggctataattctgtggatttatttctggcctctgttttattccattggtctatgtgtctgtttttatgccagcaccatctgttttggttaccatagctttgtagtatattttggtgtcaagtagtgtgatgacaccagttttgttctttttgctcaacattattttgggtcttcaagctcttttgtggttccaatttctgtaaaaaatgtcactggtgttttgataaagattgcattgactgtagaaagctttgggtagtgtaggaattttaacaatattaattcttccaatacatgaacacagaatacctttccatttatttgtggcttcttcaattgctttcatcaatgtcttacagtttccaggtctttcacttctttggttaaatttattcctttttttgtgggggcgggtggacagaggacagagtcttgctctgtcgcccagtctggagtgcagtgtcatgatctctgctcactgcaacctctgcctcctggattccagcgattctcatgcctcggccacccaggtagctgggattacaggtgtgtgcctccacattaggctaatttttgtatttttagtagagacagggcttcaccacgttggtcagtctggtttcaaactcctgacctcaggtgatccgccaacctcggcctcccaaagtgatgggattacaggcgtgagccaccgtgcccggccagttcctaagtattttttgtagctattgtaaatgggattttttaaaaatttattttttattttccctaagttattggggtacaggtggtatttgattgcatgactaagttctttagtggtgatttgtgagattttggtgcacccatcacccaagcagtatacacagcaccgtatttgtagtcttttatcccttgcctcccccaactcttctccccaagtccccaaagtccattgtattattcttatgcctttgtgttcttatagcttatctcctacatatcagtgagaacacacgatgtttggttttccattcctgagttacttcacttagaataatagtctccaatctcatccaggtcactgcaaatgctgttaatttcttcctttttgtggccacagttataccacagtttctctttatccactcgttgattgatgggcctttgggttggttccacgattttgcaattgcgctttgtgttgctgtaaacttgtgtgtgcaagtatcttttacatataataacttatttttgtctgggtagatatctggtagtgggattgctgaatcaaatggtagttctacttttagttatttaaggaatctccacactgttttccatagcggttgtatactagtctacatccccaccagcagtgtagaagtgttccctgatcaccacatccatgccaacatctaccgttttttgattttttgattatggccattcttgcaggagtaaggtggtatcacatcgtggttttgatttgcatttccctgatcattagtgatgttgagcattttttcatatgtttgttggccatctgtagatcttctttagggaattgtctattcatatccttagaacactttttgatgggattgtttgtttccttcttactgatttgtttgtgttcattgtagattctggatattagtcctctgtcagatgtatagattgtgaagattttctaccgctctgtgtgttgtctgtttgtttactctgctgactgttccttttgccctgcaaaagctctttagtttcattaggccccagctatttatctttgtttttactgcatttgcttttgggttcttggtcatgaaatccttgcctaagccaatgtctagaagggtttttccaatgttatcttctagaatttttatagtttcaggtctggatttctttttcagatagattgctatgggaatgctactgatatgttgattttgtatcctgcaattttactgaatttgtttattatttctaacagtttttggtggaattttttacaccagtcaaaatggctattattaaaaaacaaataaacaaaaaaatctccacatgttggcaaggatatggagaaaagacaatgcttaaatacggttggtgacaatgtaaattagtacatctatgaaaaatagaatggagatttctctaagaattaaaaatagagctaccatttgatatagtattctcacaactgggtatctacccaaatgaaaagaaataattatattaaaaagatacctcactcatatgtttactgcagcactattcacaatagcaaatatatagaatttacttaagttgattggatgaggaaaatgtggtatatatacacaataaaacattatttagccacaaaaggaataaaatcatgtcttttgcaacaacatggatggaaccggaggccattatcttaagtgaaacaattcagacactgaaagacaaatactgcatgttctcacttacatgtgggagcaaaataatgtgtacatttgaaagtagagtgtggaatgattgacaatggggaatcagaagggtggaggcatgggagggggttgtatgatgagaaattacttaatgtgtacaatgcatattattcaggtgatgaatgccctaaaataaaattacacttgtattccttaaatatatacaaataacatttttaaaaataaaaataggggttctataacattatgtcatcggcacacagggataacttaacttctttttttcctatttggatgccttttgtttattcttcttgcctaattacttccaggactgtgttgaatagaagtggagacagtgagtatcctcgtcttgtgccagatcttagaggaaaagctttcaacttttccccatccagtataattcttgctttattgaagaaaatgccatacttctgtcaaccactggtatagacagctgattatataagttggatcttattaataagtgagaaagtcagcaaaattaaagtgttgctgctttttatataattttaaaggattccgaaaacaatatgattacgataaaatctgaaaaaagtaaatggatatctataccagtttgctcagaactatataaggatggtatcaggttagcttggtcaaatacaagtacataacaaaaaagtaaaataaatatttttaaggctgagttcaactcaagctatttctactctgagtttgcaagtttagttatttgatttcaaatgatccttttgcttggtttgattttccccgaaatggtcaattgtgaataaattgtttgatttgattcgtagttttttaactgagtaggcaaggtctcagatttacttctcttgaagactaataaagaagacattaatatctaacctgtttacaggaacagagtttcttgagcacagctgagcttcccaaatgccatagaaacaaaacgaaatggaagaatttatctggtaggagtgtattttgatgtgacctaatagaattcaatgaagcttcattttataacttgctatacaattaatatatattgacaagccctagtgtcttcaagtcatgcataaaatgcttttgaaacaaattatcagcatttatttgtgagttaaataacttttctaagtgtatcatgagaaatgggttaaacacaactttttggcatattcttcctgctaccacttaaaaaagcacatcatttgtatatttcattttcaaatatgtgacttccttcctgttcatgatttaatccatatttttaaacataaaataagctagcttaacttttattacaacagaagtctgtttatctggagtgaggttttaaatatagacatttttgctccttcagtattgttttaaactaatgcatttcaataagactagtttattatacattgtactgatagttaaagtaactgttaatggctattttttcagggctctgaaaagtaaaaaaaaaaaaagaaaaatcactacccgaaatatcattcttaggaaaaagctgggagttaattggaaagtgaatagaaacactcactctgaatagtcaaaactgatgaaattaataaaactacatatgttgcatttatttatgttctttgttaataatcagtcactaaacctataatttttccattattcacttaccaaaaaataaaaggaaaatttagaaggtgaactagatctattctgtgttgttgtcttgttctgctgaagttatgaatgatttgtgatgaagtccaagtatgggcctcagtctagagaactggctggccaaaacaactatgaattttaacagaattgcatgaagtgctagaatctcagtttaaatgaatgcagtggctacttctaaatagtcagtagactctactttgtatcatagaagtaatacttgtaaatttacaactttgttgatgagttttgcatgattccacatttttaaagaaaaatttgctaaactgaacatatttttgtaatccattaagaacagaatgaaaactgaataacaatatgatctatgttgtacccaaaacctaatgtattttcctgtaaaaaaataaaaatctagcttctgtaactaggaacactacaaaactgaaactgtagactctttaatttcagggttcatgaaggaatttttttccatactgacatgttacattaatactctaggaattaatgttagaagtatttgaactagtattcaatatatgttaatgaaatgtagtacatatccccattggttgtgacctaatcgtttttaaatacgtacattacatttgatagatgctcaattatgaatcctgctttttcaaggtggaatatctgagaaacttgtttcactgatcaaatgtcctgatgtgatattaagatacagtactaaacagcctgaggcagtgagcatttagtctaatctggccagtgcagaacacacctgggcctccctggggttgctgtggtgaccattctgccatctagtcctcagcatcatcagggtcaacaagctaacagtggcaacagagttgtttcatttatacagttccagtgatatcgttgccttcctggctgtgttgtgtttctaatgttgctcctagctctttgccaccatttctaattcttctgctccccaagagtctttgatattatctttagtgtggcccttactgtttaccctagagatagtgaattctgttacttgacaatttaggacactgatgaacagaataaagtataattgtatcaatgtctataagtagccatttaaaaatttatacataagaatcattctctcaggcattaaatgaaattagagaaattatttcatttttggttttttttgcttgtttgtttgttttgttttgtttttttgagatggaatctcgctctgttgcccaggctggagtgtggtggcgcgacctcagctcactgcaacgtccaccttccgggttcaagagactctcctgcctcagcctcctgaatagctgggattacaggcgcacaccaccacccccagctaatttttgtagttttagtagagacggggcttcaccatgcttgtcaggctggtctcgaactcctgacctcatgatctgcccacctcagcttcccaaagtgctggcattacgggcatgagccaccatgcccggccaattatctcggtcttcaaactctgttttagtacttaaacaaagccttaaactgcttcaagaacactgaatgataaatgaattattctacattgaaaatgaacttttatcaattttagttgaatatggtttcttcttccttgagtccagttaaaggtagcttgggagcaatactcaagtcacatcacatgtagttaaacttttatattccgaatcagtcctttaagtaagacagccaggggttgataaactaaccaaaatcctatccgtcacatccattacaagcattacaatgtaacagataacctgaattttcttatatattttgtttcttatattcttaaaatttagtagcaaatacatgttcattcaatttgcctattgaaaatttatcatatttagctttggggaaatatttttaatttttgagattgaaatataaaatactctgttagtacaattcctagaatatatttaacttctgtactccatatgtttagaagaatgagaagtgtattgaaaattgtatcttatagttgttctactataaaaccaattgtaaatatcattcaatggataaattattattatcattgttgttattgttatttaatcccaaattggtctacttaatgtggctaaaatttctcatagactctaattcagaaaatatattttgttttaagttatttgcactaactacttgtgatagatatttaaaaatatatgtgactcatcctgaatagtgattttatgcacagctgtagatgcaaatgaagtatatttattaactaacaaatgctataagcatttttatgttggtaaattaagactgggttgcatgatagttgaatttaattcatagaacacaattatcaactaccctaaaataatttacataactatgacaagttatatcaaaatttactctcaaattaagttggttattcaaaatattcatttttatgtccattctgtataaatacaagtgattgccatactgtaagactcatgctcataatggagaataaataatattttattgtatttatttatttatttacttatttatttttttgagatggagcctcgctctgtggcccaggctggagtgcggtggcgcgatctcagctcactgtaagctccgcctcccgggttcacaccattctcctgcctcagcctccccagtagctgcgactacaggcacccgccaccacgcctgactaattttttgtatttttagtatagacgtggtttcaccgtgttagccaggatggtctcgatctcctgacctcatgatccgcccacctcagcctcccaaagtgctgggattacaggcgtgagccactgcgcctggccgcgagaataaataatattttctaagaaaattaacttttaatttttcacctaaaaatcctaattttccatttttttctatgaggaaattatcattattttatttttgttttaaaaacaagtttcacagataggagtatgttgtgtgctctattttattttttcacccatttttattctcacattttatttttagtaaaactaattgtcatttttttacagaccagaaactctgaaaattagaaagtgacattcatgaatgtagttattaaaaaatactctccatctttcacaggaataaatgttagaagtatgcttatttatggcataattaccagaggaagagaaaattatcctatcaattgaattttatctagaaaatgaaaagtattgttagtaattcctcagtaaatgatacagctatacataataatatataactctaatttagatatgttcttaacgatttgctgaaacaacccagaaatgattgatccagaatcatgagcaaattagataaatcattggcaacaacttaaaaaatcaacaatttgaaaattaaaattatttttggtatatagtatgtgccaagcttagtattaaacataaagccaataaatgcaattcagcatgtgaaaatgtaactttgaattaggaaaattgcagaatgcagagggttgtatttattactctatgtttcttcaatcttgttattgacagaaatttgtatgtatagaaagctgtatgaaaataagtaactttccatacaaagcccaaataaccaccctttattatcgctcaaatttatttatttttatttatttatttttgagatggagttttgctcttgttgcccaggctggagtgcaatggcacaatctcggctcattgcgacctccacctcctgggttcaagccattctcctgcctcagcctccctagtagctgggatgacaggcatctgccaccacacctggctaatttttgtattttcagtagagaccgggtttcaccacgttggccaggctggtctcgaactcctgaccttaggtgatctgcccaccttggcctcccaaagtgctggtattacaggcatgagccaccatgcctggccaattgctctcatttaaattcaaattatgtagcatttatgctccccatatcattattgcatttacttcataagacatacttacataaatttgatttgattgggatattacttacgacattatgttaaagatacattgcactcttggcctgcccatttttaacaacgtaggaaacagctgcaaacactccttactcctgcaaaaatgcaaggaattgaaaataacctatgtccaatcatgttgcacttttgcaaacattccctacctctccccaaatgaagtaacacagttttgaataatttcttcatcatttcttttctttttatatgtttattaaacacacacatattattcctaaagactaaaattttattttcaatatgtttggctttatggagatgatatttaccatgtagtatgttccattcaggtatcaagggatactgtactcagagaatgcaccatctgacatttttattaaatttattggatttaatattgggttttttgaattataatgttggatttatttttttctttggatattatactgctaacattcatcgatattgttttgtgttgttgtggttcttttttcagttctgtataatagcccacatagtagtaaactattcattatatatatatatatatatatatatatcaatgtacacttgtatgtatgtatgtgtgtgtatgtgtgtattagaacagtggtccccaacctttttggcactagggaacagttttgtggaagacaattattccacagacaggggtttgggggaggtgaaaatctgggggtataggggttgtggtttggggttgaaactgttccacctcagctcattaggcattagattcatataaggagcctgcaacttatttccctcacatgcgcagttcacagtagggttggctctcctatgagaatctaatgctgccactgatatgacaggaggcagagctcaggcagtaatgtttgctcaccttctgctcacctcctgctgtgcagctgggttcctaacaggccacagaccagtaccggtccttggcccaggggttggggacccttgtattagaagacacacatatacaaaaccattacaaatcacaaacatatatacatatatacaaacacatatataaatacgtattgtctatttttaattcaaggtaagttttggcaaatagaaagtaatgctttcttaactatcatatttattcaaatatatggaaatttgcctccaaatatcaaatttgttaaacaggtggagaatagaagtaactattcatatcaaaaccatttaaaatataaatataattatcaaaactctactatatattctaaattatatattttttatttgtgcagaggaatgcagttgtaaagaaaataaataaatttatattttgaaatggggcaaaaaagatgtcaaatattgagatataaaaagtagtaccagataaaagatgcatagataaccctaagaatgagaatcacattttatatgtagggctaagccatttcctatatatattttctggctgactaattagcaatggtaaagatcaagttttacatcaatgctttcaaatcatggtgtttattttttctacttgctgagcccgtactttggaattatatattactatattttattgtgtgccctcttgaatgtatttattcatgtagcaaaaataaaaattaattaattaataagataaaggtaattatgtaagattaagaaagtcacagaaacatagaaactgacctaagttagtgcgtactataataaaacctacttatttctttgtctatgtctaaaaatgcatttctttctctatgtctaaaaatgcacaattcaaattccagataaactctagacctgcccatccagtttcctcctctttgtcaacagaactccaattccattcgggtatcaagggagactgtgcacaagcaatgtactcatcccaaagaacaaatcatgattggccaggctaatcatgttgatcctgttctttttctgccagggactgcctggaatggagtgaaattgagatgcctaaaccaatgacagaaaagctacctctgcactccttgctacatgaaataattcaccttttttcccgagctacatttatctggtattcaggtatatagtgttacatgcaatagatatatgaccatcagtgttatatgcagtagatatatgaccaatctagttttttaatataatggtatattggatattttttatactatcaagggattcttctccccagagataccaactgagaaaacctgtggttggcagtgcaggtggcttgtgggccacatcttgagaaaataatgtcttaaaggaattccagtgaaataaataaataaggaaaatatgtttagtttaacttgtgaagaaagcagcaaatgttaatgtgtgaaataagaactttctagttggggatacccttagagctacaatagtttacatttactgaggattcaaacaattccaactgaaatagaaagcaattttatgtcaatacttaaactactcaagcatttagaacatgttactaaaatgttagtatataatctctgaggtagcctataaaaatgtttcagctttctttttacaaatggaaataaatatcttgaagatgaagctagaaacagcgttttctcgtgttcaagaggcatggtattgagaaacaatttacagaatgaaatgagtgaaagaggaagctacagtcagatattttgagatgatttacaggaaagcataaaacaaacaaaaataaaacaaaacaaaaacaaggcagctaccagagagagatactgacagatttttttcttaagtactatctccttttgtcttttagtggggtctatccacctcactcacttcctttagcttaagttgccttccctttaccaaattttgcctcttatcattaacagccacctatctgtcttctctctgctctccacagggctttctttgttccttgaacttgcaaagggacagttaactaatctcattaatggacatgacatttaaaacttgatgttctacattctttgctttaaaacatgtggcattcatgttagccttaggaagaactagtcctccctgagaatgtaggggatttggggttgaatggggggggtgacaggtgactcatcacatcctggagaggatccaatgccacattggtttgcattttgctattcacaagtcactatgataatttcgctacttaaaaaatgatataccatctgaaatttttattaaagcaatatatacatacacacacatttagaagatcatcacacaaataaccatttatttgcttagcttaatgttgcttaggtatttcctcataagggaaaaacccagaatcagtcatttatatttatatttaaaatgtgaaagaaacttcttacatgtttgtatatgacagcaacaatgctaaattttttcttgattcactttagccaataatactttctgttatgatttagttggataattctggattatgagtcagtttgaaatgaggccatgacaaaaataaaatcaaagtaaaactaaaaatatcgaacatcaagagagtatccatctcctaagggtttgaggtgatgagtatcccaattatcctgatttgatcattatacattacataaacacagcaaaatcttatgtgacctcaaaatatgtacaactattatgtatcaataaaaggatccacctcctattgagaaactatacttgaacccattttagtatgtatatgtcaggtacatactgcaaataataattggaactttggtatggaccaagaataatgaatggacatttatctacaggtttatttagacatattagttcttgataacaattgattatgaagacacgaactacttctactaatttaatagaactagagaatcagggaaagacaagctgtatagaatttaaagtggaagaatttattatagagttaaagcttcatccattttattaatgctaaaaatagatacatttatcattatagagtcaaacaaaaaaatttcaatgagtgaattttaatgtactgtagactgtggagatattgaaagtttaactgaagaaaatctgtctagctttacttctcatccattaaatagagcaagtatgcttggcaaaagaatacctaaaaaaatttccagtcccttctctaagtgacaaaattctgatggcctctcgatattttacaacaggtataagcggttatgaagtaaaaatatcaccgtctctgatggtcatctagtctctaatgagggaaaccaataaatccataaatactaatgaaatttttcaaactctaatccccattcttagttatcaatttttgttattttaatagtaatttattcatgtataaaactggaaaatcccatcattaattagcaatagctctttattaatattttaaaatagtttccaaactaaactcttaatatgcctaatgtcatgatccctttaatgagaaactagccattaaaagaaaatagcttatactcatttctatatataagtacatattattttgtaaacagttagcagaaaatttcaccgttaaaaatgaaatattttccatttttgcatttgaatatctgagaatatgttcccgatattcttgccagtttataaacctatattttaacagtactggtaatgcttaattatacacaaatttgctttatttcacatcacaaggctttgtttgtctggagcatacactattgtttacactgtacagttctttttgttacgatttggatgcttttaaaagagattttaaatatttgctctcaggtttattaaaaaacatagacttgaaaaaagatatgatatattcaattataaaaattgtattaacaaattctaaaagtttatcattatcctaaaatttggggtctggggcaaattagagatatgcaaaaatggttagcaaatttttgaatgtgtcttagaaaaaaaattttcacttgcgaccttaggcttttccccctatattttgatatagacttcacaatatagttcttataatagtggggagatacaaaacatttgaaatcaattttaattgacaactttaagatttattatttgatgtgatgattcgaaagaaataaatcagagaaaaaacagcatgctaaaatgtaaatcttatacagactgattgctttggtaaatatataaaataataagagttattaaaacttgtttagaaaaacccaaaatttggacaagattgaggaacaaaggtggttttggataaaggttttgatttcatgagttaaatttttttttcttcttattgcaaaatgtgatggtctattcatatgattttcatatgacaaaagctcctttagtaacctaaaagatatttgaatgattttaagaaatagtttgacataaaatagaacacctcacgtgtgcaattacaccattttattttcttatatattatccttctttatatttgtgcattattttataatgtggagaggttatattacttttgaatatctattatatgtttacacataaacacagagaatgcacagtaagtgatatctatggcactctattgaaagtaaattcttggtgtaacactcttgatcatgaacagatatttaccaactatcaagaaaaacttaagacattgagcaaatgtcattagttaagtcattcaaatcacctcatatttaacaaatctaagtggaagtccaaggggaattccaaataaacatcactgttatactgaatgtagtcaatagagaattattatatcattggagttaaatgaacacatccattacatttctaaataaatgtgggaagtgctttttatcccagacggaataacaatgctaaaggagattgtcatccgtattttataggaaaggtactccagaaatgtttatgttgctaacaatcaaatttactaatattagtcaaacttgaccatataaatcggatttatataatccatatcttaaaattctaacttcttaacaaataccacttgattattttaaaaccatagatgaaaagaacactgagagggaggtttagaagcaggatatatgtatgattttgatgcttcaataactgcaaagccttggacaattcacctctgtgtttccccagatttcatatctgtaaacagactagatgatctctcaaaagaattccacatctaaaactctctttttctgtgtcctgcctttcagtatttttcctttaattgaatcatttattttcttctttgatcttatgcaatgctacaataaaaacaaaaacaaagccaatttgataaaatatcacattctctattagtgatttttgttatctgagctgttacaaaagtggttggatttattccacaaattaggccatccatacctgcctttctgtaatcatatgcatgaagaaagaaaaacttcacaacttgtgtaggagtctaatttttcaatttagtattgacagtctgaccatgggtttgagtgaaagtttagattttgtagatactttggtttcctgataatctcaaaagctcagttatactttataatatttatgtttacaatcaagaaagtctttacatatatttctataataagctataaatattatcaccttctctgaattgtctaattattgtccttctgcatagacaagctagcatgctatacatcatatggataaagccacaaatttcttgccagataattttgaactagtttcaaatattagcaaatatattagggacaatttcatgtcaaaacattgagtagtcatgatataataaagtataatagacaattcctaatgtttaaaaattagtattcaacagtcacagaaagaggaaattatgctttagtttgatggtaacaccatcctagcgtcaagcatggttacatttctcttaatatttttcctagaaaagcgtggcttctagcttatttgattaatacaaatccttcaaaatctttttattctgttctaggatgagaggaaatataacatttatattttaaattaatcataaactatacattaatcttgatttaaaatagaaacctacttttcaaccgagaatgtacacctgtcatctcaaaagaaggtatatttacatattaattttatatttcagatataaacatttattaaattctcattttttgtttcacctgaactaacatgtagttagagaaatacattttagaaaaaattaatagtaagtgtatcttactcaaaataattcactctagattttctcaattattaaatggcaagtgcaatgtttcttctttacagtattatgatattgttactatgcagaccactattcatttttcctgttacttcctataactgagtttcttctttagtattaataaaatgcaacatctatatctcttcagcccctttgtaaacgtgtaacggagtaacacatcttgaacaattctagtcaccattttacgatatgtgcaaaaattcagggactgtaagtataacctacctacaatttttctattttcagaaagccatacttgctcttttggtgtgatcaaggggtttctggagaccgagaagggaaaatgtgtccatttctgagaaacactcactgtaggaaagaaggtgctatttgcatttaatgtaaataccactttcgttccttttaattaaaagagaaacagaaacccttctatattctaaacataaaaaataaaagttttttctcaatatggtagttgattgcaaagaccattctgtatgtagagatggtcctccctccaattttttttagcatcatgctattttcatttagaaaggtcacatgagtcttttgctgaaaccaatgtgattttcctaataagctcaccatgctaagtgatccaacagaattgctctgtttgttaataaggagagtaaatgacattacttgacagaaacgctctttcaatggtggtttattccaagagattaattcatccttacttgtccagtgtcacatatacgttattaaatatgcaatgtagcatccttcttattcaattatgataatttgctgttttattaatacttggaaataaaatatatcactccatccattagtaatcacggtgatgaaactatgtgataccatattagaagcaagtccaaggtattagagatccatgttcaacttctataaaatggtaagttcgataagccattttgcacagttatatttttccaagcttcttgtccttcagatttagttagtggtcaattcactattagaggaatgtaattattttctggttggcactgaggatgagtaagacaaaaatcaccctatcactgaaggtgccatagcctcaaataccctactcactccagctgcatttatatagaggctctcagttgcacaaaagatcaaactgttgtatctaaagatcaagccagaatgcttttcaaacattagatccttcccaaagcaattctttgtgtaaccagtttccaaaaaagtctgaggaaaaatttccattgtttcctatcgttattagactgttgggtcctactgacgtaataaatatacaaatcactattgtttcagcacaatgttttatgcatgacattttaagaactgtacaaaacacaatattaaaattctgaagtgaaaaataatagcattatggctcattacattctatattgtggtagtttgaactgtgagtaactgtactgtcatcctgtcaactcactttaaaagatccgctatattgttttacacaatgtcatttatttcacaggtataactataccaaagtgttccggtttggaaacatagtgtaaatgtttaaaaatattttcacacagttacctgaaaaatacttgcactgaaagctaatcatcagttacagaaccaccaacaaaagttctgctactacaaatagttttgatgaaacaagacaaacaacgtactaaacattttggaataatttttcaatattattattaccttctgatttgttcttagactttaaagattccctaaaatattggtaaatgatgatggaaacctttttctaaaaatattgctttgatggtaaaacgactggcaacaaaatgacagaagatagccctagagatgcctttctccactttatcctagtatgtctttagagccctgatataaatatatatgatattccaagaccctttgctttcatcattttacacagtcactcctacagaagctttcctcataactgtaggatcatctgccgctgatggtttgttcggatcttaattgtcttatgtagtacatactcaattaaaactcatgctggagcaggactgtctagactttggtaactgcttattaaatagttaagatgttgtatgaggagcaagtgacaaattagcaaacatatatgaggctttgaataacagccagagtaataccaggctgaattaattaccatgttaaatatatgcagaatgggaaaataaaatacctgctatgatatggacaaaacttatcttaatatacttgtttgaagatgggcgcttccaaaggaagctcatgagcatatggcgctttactgtgcgtttaaaaaattgtgctaaaaacatgttttgtcctagtaaatgtttttttaaaaatagactttgttttttagaggagttttacgttcacagcaggactaagtggaaggaagagaggtttctcatataccatctagccctacgaacatacagcttcccccaccatcaaaacttcataccacaatggtatgttacaattgatgagcctacattgatacaatgtcagccaaagtccatagattacattaggtttcactcagtgttgtacatgctataggtttgggcaagtattcaacgatgtgtccaccactatagaatcatacaggttgaacatctcaaatctaaaaatctaaaattcaaatgctccaaaattcaaaacttttgaagtgctgataagatgtccaaagcaaatgctcattggagcattttggatttcaaattttcagatttgggatgctcaactggtaagtgtaatgtaaatatttcaaaatcgccccccccccccaaaaaaaaaaaggaaatctgaaacacttctggtcgcaagcatttcggataatatataatcactgccttaaagatcttctgtaatctgtctatacattccacctcctgccgcaacccctggcaaccactgaaaccactcatctgtttactgtgatcatagttttgccatttctagaatgccacatagtcgaaattcaacagtatgtaaccctttcaaattagcttctttcacttagtaatatgcacttacagttcccccatatttgttggtcttttttcatggctttatagctcatttcaaaggtcctgaataatattctattggctgcatgtacctgttcattcattcattcactcacctatggaaggagagcttgattgtttacaagtttggtcaattatgaataattataaatatttgcactcaggtttttgtgtggatatgttttaagcttatctgggtaaataccaaggagtacaattgctagatcatatgataagtgtgtgtttagttttgtgagaaactgccaaattgttttccaaagaggctgtacccttttgcattcccaccagcaatgaaagagattttgttgttacataacctggtcagcatttgatgttgtcagtgttttggattttggccattctaagaggtgcttaacaggtaaatatttttaagtaacaataatgatgctttcttaaaaagattttaaaaaaattcttcaagaatcagcgacacactcctaaaatccaaatactgaacaggagtgcatgttcacattctccagtccagttacttttcagtaacatagacaacagcactgccctactaaaaatcttcaagtgatgtgttctcaaaacatcatcagagaattaaaattagcgaagacaagagaaaaataataacctctgaatcaaatagataccttttaaagggatagtcattactgttacaaaatatagagaagattgtatacttgctattatatttacataaatattattaggaaactcatcaaatgcctcactgagaatttaaaaagtattttgtatcagctttatataaaagcctatcaaaagtgaaatgggattaatttactattacacattcttattcattctgttttcttgctcatcactttatacaattatatatttttaaaaagtacttattgcctttgtattttgtcgatgataggttgtaaggtactgtagtacagaagctgcatctatgcctgtgtgtctcctaaacagtcattgattcaattaatatttgtggacctgttttccagctatcatgctagtttccagaagtatgatcaaaaattacaacaaaagcgatccacacttacacacacaacagcagtcctaattctcaagaacctgtattatagacagtaatatagatacataaaaacaattaaaattcagctttaataagagaaacctctggtgtttggttttatgttaattgtactgtgtcatgatagtatgtgtgtatttttccctaaacataatgatcctagtttgtcttctattagtattttagtagtatatgcctgaatgtgagttttaatttgacattgtaaagtcaataaataacgggagattaaatataaaacatttaaacctcttcagttaagatggcatggaaatttcatgacttgacacttatttaatatatagaagaataagaaagaaaatataaaaaaagaaagagtgttataacacagtaggacttagacacaatcttggcacctccacatatcagacacagtagctgcagtcctgacagactattttccccccatgggtagtggcttcgcatttagattccttcactaagagtccacatgtacaggataaactagaattaagatcactgcttgaagtcacaagttatggcaaaagttcacccagcaatcattcttgaaaagaaaaatgtcttaaaaattttgctgacctgctgcctgagagcctattatgttaggaatctgttacactagagatacgggaagaacacacacacacacacacacacacacacacacacacacacgccatgaaggcagaagcagcccaaaacaaatgaatttgagtactgaatcttcaatatttctaattaattatcaccacaaacagcactccacgtggtagtagactatctgaatctaggcagctattccaggggccagatggggacaacagcaaagtggtggaacagatataataaacacaatgacaataaaagcaaacccttttactctaaatgctccagaaatctgtgaataaataaaggcctaaaaaaggcagaaaaccaccaccaccaccaccaccaccaccaccacaaccacaatgattcaaccatgagttcagtctagatgaaattattctcatatagatgtctgaagaacatttttaaataatatgtttagaattctcaacaataaaattaaaagataaaactcaataaaaagaacaagtagttataaaacaaaagcatgtagaaattaaaataatttcatattgagaagaaaaaagctataaatgttggaaatgaaaaatgtagtaaatgaatcaattttaaagaaataaacagcttaagtatctggattgaacaagaagataaaattagtgaattagaagatactaatgaagaattcatccagaacgtaacacagggaggcaagtaaatgttaaaaataaaatactaaggacataaaagatggacaatattatacgacaataagagttcctaaagaagagaatgaatggaattgcagagaagccagatttaaagataatggctgataattttatagaactgatgatagacaaagggcaaggtttatctaagaaagttttgaagaaaaacaagttagggtgtctggccctaccacatgtcagggctaaatataaatctatggtaattgagacatattatagtactggcacaggaattggcaaatgaagaacagaacaaaaaaagatgcccagaaatactaatgtacatactaatctaatgtacatgtatatactaatctcgatgcaaaacagaggtgacactacaggtgaatagagaaaaggtagacatttaaacaatgatggtaggacagttatttactctaaaataattcacaaaattattcactattcacaaaaaaacccctaaaaattatttccaagtttatttagagaccgatgagtgaaagggaaaaactgtaatacctaaagaattacatgaaaataagaaatagaccaaaagtcaattgaaaaattggcaaaggacatgaacagatgattcagagcaggaaataataaagggtcaatgaatataaaagatacattgatcaaaaaacaaatgagatataatttcatactcatcaaattgataaaaattataaagtgtcaatatctagttgataagaatttgaaaaatgggggatgcatacactactgttggaggcataaattggtaccaccattctaaaatcaagtacggcaaaatgttatattaatattatttttagtcatcctccagttgtttgacatatttcataataataaaatatatacatgtatcaaaatagctcaatttaaattagaaaatgaatatacatgacctatctttaagaactagtctgtatgtttaccatttccatttgaacattttttattcatttctcttatagatcctatatatttaatgtgttcttgcttttgctgttaaaggcaagactggagacttctttaaattacagtgctttatcaacatgcatcattttagattcacaagcatccttaaccagagtcagagagctttttaaaaaatatatatatatatatatagaaaactgctcccttttactttctgtgttatatggattttgagtttcttagttttgagctatggaattttctttctatgggtttattctttttaaaagtagtgctatttagatttccatttatatattgttctttagccccttaagcaaatcatcagacttaagggcaccattcataatactattattacatattattagtcaaatatctataaaaagatgaatatgacaccaagtgatagaatgtcatcagtctctctaaaaataatagtaataaaaatagtaatacaatcatacaagaagttgtttgctcaggttaaatttaatttataccctgaaataataagaattatattgctttgcacgtctgggaaacagaacttacaaaaaagggaaactgactcataaagtacttatattttaaaattatttatctaattctcatttgttcaacaaattgcacaaatatacaagttgaaaacagtataaaaataatcttacacttaagatcttctttcaaatctagtctaaacaagtctactggaagactttggatagtcttctatgttagtactttgcctctgctggatgaaagaacacaggcaatcaacacagttaatgaagaaaaatgtacatattatagtcattgtttggcctgtatatacatattggaacttactctgctaggataaattgcacaaatatacacgccttttctaaaataaatgcactgtcgagtccatggataaagtcctatccttgccagataataattctaaaaacaagaaaccaaaaataaaaaaataaaattttgaaaggaaataaaacttcatgtacctttcaagggagtaggtgacgaagatggtgctagaatgactctcagcctagggtggtgtgtcataagattagaaagatgtgttctaatctctgtaagccaagtggtagttcatcagcaaaaattatcagttcattgttaattcctggtttatttctctttcagtttttaccgcctaaagtcttgtttaaaacttttgactgggccagatttaagattacacatgttgttaaggggcaaggcaggtcctagtttaccctaggattagaatgttaagccaccaaccagcaaaataaccctagggacaaaataaagtcagttggatcagaattgaaactgaggggtctccactcttctttccccaaagaattttctccttcgttatgaatctggaggatatgtattttagtaaagataaaggttttttttttacatatattgattggagggcattcataatcaattttcaaagaaattagcattgaaggaaataaggagcaggttacaatttctttacagtcatagtaggttgtgggagagatgctggactataaactcccatattctgagcttgttatcctggcacagaaattatgatgacattgaaaaaaatattttcataatgtagtccattaaatttcatgtctacattatggaaactcagaggtttatggtcacataagagtgaaagggcaatcaaggagtaaggaaaaattatgcagaaaggagaaaagcaatgatgcttggtgagaacaatcatactaagtgtgagaacaaagatgatgtacctagttcagattttctagtcacttgaaatattactgacctctaaaacttagggggactttaggctgagtccaggaatttttttttccctaaagaactgtagacttggcaagtctatatttagtgtactcactgtttttctgaattttgcctagatcctgactgtcacaggtacagatgaattcaacacacccggagggctcttgttggaaacctgaagaatttccatgaaatctccaaaagtcaaaagatgccattattacaacactctagaggttggcaaactaccttttatttatttatttttttgctacaattgaaaataaaaccaacatgtattgttccataggccccttgtaaatttatttgtataaactgctgagaatttacgttaatgtcttttacttcttctttttgcatttcaattgaaatcctaggaaactttggcaataaaagatccaataagttattgataatttaaaaaatgattccatagcatcaacaaactatattaaattccaatatcccattctatgattcagtcttggcccatgtaaatctgtgatagaaaataagctgaaaataccaatatgggcagaacaaaatacgtaaagataaatctctcaatttttatatcatacgttccaggatatttaatgaaaaacactttgagtcctaagagtccatattaatagaattccacgttaaaactcctgaacttaatataagctttatcagcaacatagctttcagttaacataaaataaatgtaaataacattgacaggtcattttagtactaaatattagtgctttataagcaactaaattatttagtcagctttattccagataagaagacccttggatttattaaattatagattaaatactgatgtgtctgactattcctgagaaacaccgaagccccactatgtctagaatattgatatttactgaggttcatacataagtcgctatgctagtgagagattcaagatgaaactctagctttctctttattaaatcagccttggcctccccttatttttatgtaggtattgatttccttgatttgaagcaaactttcctcttttgagaaaaataaatcacaactcattgctttaccatctctcccacttcttctaccctaaagatagctgacaaggctggcaataaaaaggtagaaaaagtaaagagtcttacaacgtagatgatttttgacccaggaagtacaagtttaatataattaaaagtgcaatgttgaaatcagcaagagtttgtatttttgaattattcaaccccattatgttctctatagaaaaccaaagaaaaataaataaccaaaagagaagctgcaaaagtgtttcattgagtacagcgttcaatacctcgtcaaataggagttaaagatttagtgaaagttgaaagggtggttaacttgaaagaagatagttggaggcaatacaaatatgaattatgatgtttgcaggttttagaagaaagtcttggattttttcatcaaatgacagatgagagacgaagcattttttatttctgtaataaaaagtatgggtggctatactgtcacttaaatatttttaattgcgaagaaacatctcatcaagtaaaaagtagataagaataaacaagacgctaagcatagacagaaagtgtcctattttaatgcagaaaaaagttttcaataaaatccaacatcccttcatgataaaaaccctcaacagactaggcactgaaggaacatacctcaaaataataagaaccatctatgacaaatccatagccaacatcataccgaatgggcaaaagttggaacgattcccactgagaactggaacaaaacaaggatgcccactctcaccagttttattaaacatagtactggaagtcctagccacagcaattaggcaagagaaagaaataaaatgcatccaaatagaaaaagaagtcaaactatcttttttcactgacggtatgattctatacttagaaaacccaaagactccaccaaaaggctactagaactgataaacaattttaacgaggtttcaagatatacaatacataaaaatatatttttatagtaaaacatataaaaattaatagcatttctatacaacaataatgaccaagctgagagtcaaatgaagaacacaatcccatttacaatagccaaagaaaatgaaatacctaggaatacacctaaccaagatgctgaaagatctctgtaaggagtattaaaaaacattgttgaaagaaacacagataaacgaaaaagcattccatgctcattggaagaaacaatataattaaaatggctatactgcacaaaacaacttatagattcaatgctgtccttatcaaactaccaaggtcattcctcacagaattagaaaaaacaattctaaaattcatatgcaaccaaaaaaaaaaataaaagagcgcatatagccgaagccatcctaagcagcaagaacaaaattggaggcatcacactacagtacttcaccctacaataattcacaccacagtacatcacactatagaacttccaactatgctacaagactacagtagccaatacagcataatattggtacagaaacagacatatagaccaatggaacagaatagaaaacacagaaataaagccatacaccttcaaccagccttcgacaaggctggcaaaaacaagcaatggtaaaaggacttcctattcaataaatgatgccaggatcactggctagccatatgcagaagaatgaaacttgatccctaccttttgccatatacaaaaataaactcatggtggattaaagatattaatgtaagacctaaaactacaaatcctagaaacaaacctaggaaatgtccttcttgacattggcattggcaattttttttttttttttgacagagtctcactctgtcgcccaggctggagtacagtggtgtgatctggactcattgcaacctctgcctcctggggtcaaacagttctcctgcctcagcctcccaagtagctgggattacaggcgtctgccaccacacccggctaatttttgtatttttggtagagacagggttttgccacgttggtcaggctgctttcgaactcctggcttcgggtaatccacccaccttggtctcccaaagtgctgggattacaggcatgaggcactgcgcccggccggcaaagaatttttggctaagtccccaaaagtaattgtaacaaaaataaaaattgacaagagggacctaattaaactaaagagcttctgcacagccaaagaaactatcaacaaagtaaacagataatctacagaatgggagaaaatattcacaaactgtgcacctgacaaaagtctaatattaaaaaatggacaaaagacatgaacaaacacttctcaaaggaagacatgcaagcgaccaacaaacatacgaagaaatgctcatcatcattaatcatcagagaaatgaaaagcaaaaccacaatgagataccatctcacaccaaacagaatggctattatttaaaagtcaagaaaggctgagtgcagtggcttgcgcctgtaatcccagcactgtaggaggcttaggcaggaggatcatatgaggccaggagttcaagaccagactggccaaaatggtgaaaccccgactctagtaaaaatacaaaaattagctgggtgtggtggtacacatctgtaatcccagctgctagggaggctgcagcatgagaatcatttgaacccaggaggttgaggtgcagtgagccaggattgccccattgcactccagcctgggtgacaaaaaaaaaaaaaaaaaaaaaatcaaaagataaacgctggtgaggctgtagataaaagggagtgcttatacactgttggttggaatgtaaattatttcagcccccgtggcaagcagtttggagatttctcacagaacttaaaacagatctatcattcaattcagcaatcccattactgagtatatacccaaaggaaaatagatcattttatcaaaaagacacatgcactggtatgttctttgtcacacaattcacaatagcaaaaatatcgaatcaacctaaaagctcatcaatggttgactggataaagaaaatgtagtacatacacaccacggaatcctatgcagccataaaaaagaacaaaatcatgtcctttgcagcgacatggatggagctggaggacattatattaagcgaagtaatgcaagaacagaaaaccaaatgccacatgctctcacttataaatgggaactaaacattgagcacaacggacataaacatgagaacaacagacactgtggactactagagtggggagggaccggcggggaaggagttaaaagctacctattgggtactatgcttactatctgggtgcaatataccgttttaacaaatctgcatgtgtactccctgtatgtaaaataaaagttgaaattaaaaataaaagtgtcctactttaaagaaaacatgccaggcacctattacacagcaagtatcattattcgctcactacaattattttcagattgaggcaagttcatagttaaaaatttaattggggtgatataatacaatgtggtttgtttagtagtagattttattttaatagtgttatatatgacttaagtttatacaatcatcaagagtctgatggggtctctgtaattagccatactttactgcattttatgagtagaattatatgccttagtgatgtttgcaaattcggagttttgcaaagatcttgggacaaataccctggggctcttcagagtctaatatatacgtaaaataaaaggtcataataaataaaatcatatggagcttatatatatgtatatatatataatcacagatttataatgattaccaagtggatcgtagctataagtgatttaacaggggcaatgctttctttactctaccctgatcaacacaatatttgggtttatgtctctagtgagataacgcttatgtttttatcttgatacttttaaaattcccacttcaccttctggtccttatttttttcatatatcatcaatgggtattcaaggaaaagaaaattattgtataagggttgaaaacatcaagaaacaataaatagtcagatttttaaaacattttcccaaactatcttttgagagccaaaattgtagctgtgagtaaagtaaggctgagtttatcctaaagcaatagacaaggaaaaaaaaaaatcagacaaagaatggcaactctatacctctctaccctgagacacacctgagaccaccctaaaaatcaccagggctgagaataggaggcacccactcataaaatgtatctacccactctcatttgcatggctctacgtgggtccttctgcttttgcaataccttgggacatttacaatcaaccccctcacaacagagagttaagtgccttgatttccagacagtggtgagttttagtagggaacgcctcagcttagacacttgagaagaaactagacggcagcaaaatccatcccgttgcacacgtcctcaactaggaaatgttaacaccttccaagattatctaattttatggtcaataattggtcttcagaaaaagagagcaaatataagcaaaatataagggaatagtatataaacaaaaacaatttcaacacaggaagctgaataaactattaatttttagagaaagggtcaacataagatcactgcttttttatgctataaactatatatatggcccccaaacataaatgaatataatcttggctgtatttatttttattgctttaaaaatgaattatttatattatcaacagctgtggctaaagaaaaaagacttttgtcatccaaacaaagaactatttataaccctgatattccaaggtgtatttaaaaaggtgttatttgtggcaatattgtatctattttctcgaagatcttaaaattagcaattactatcaatgaacatttattgaatataaagtaactgtatagcatttgtatctaatgcatttctaattgctaagttacagttccaacattttcatagtgtccaagtgattattttatatatttctttttaaataataaaagtatcataaactttttggaaaaactaaacttcctattttattgctacttattgcctattatttaatcttttatatgttaacatgatcaaaggtgtaaaaaattaatgatccttaattttacctaaaactaaaaaaaaaaaagcaaatatttatcaaatgctgaatattttttaagcactgttagcaattatctatctgtctatcctagaatctccactctgaacactgcattccatgtgatgaaacattagatatgaaaacacaaggctgggcgcggtggctcatgcctgtaattccagcactttgggaggccaaggcaggcagatcacctgaggtcaggagtttcagaccagcctggccaacatggtgaaacctcgtctctactaaaaatataaaaattagccgggtgtgtggcgggtgcctgtaatcccagctacttgggaggctgaggcaggagaattgcttgaaccccagaggcggaggttgtggtgagccgagatagtgccaccacactccagcctgggcgacaaagcgagactctgtctcaaaaaaaaaaccaaaaaaaaaaaaaccaaaaaaaagaaaacacaataagaccattcaatgatttaagttaaaacatgaatagtgaccatgtgagtggcaaagcaaatgtgtgttctttttcatttttattttttttgagacagagtctcactctgttgcccaggctggagtgcagtaatgcaatctcagctcactgcaacctctgcctcctgggttcaagcgattctcctgcctcagcctccctagtagctgggattacaggtgcccaccaccacgcctgactaatttttgtatttttagtagagacagggtttcaccatgttggccaggctggtctcaaactcctgacctcaggtgatccgcctgcctcagtctcccaaagtgctgggattacaggcgtgagcctccatacccagcctccctgatccctttaagatcttttcccccatttttccaatgacatcttatatgcatatacatgagatagaatttgtgttctaaattcaaagaaggaagagttcattggatttggggagaacttggacgatgttgagttggttggtattgatcagagaggaaatgtatttatagagaaatccatgtagagtgaagtaattatcaaggttattttgtgactgatatgaattcaaggggcagtttataattcagtcacatgttaaagaacaaaaaggacgaaagaagaataaagcagatagaatcgtgaaatgggttacattatttgcaccataaagtttaagtaaatcaaattattgggaatattctgagatagagctaaagtctttctcaagagtcatggttgaaaccacatgttgtggaggaactgatggtgattgttgccccattgtgggattcctccctatggtaatgacatcaaaatgaaaaaaaaaaaaaacacacacacacaagaaaatgacgcagattgtaattagaggtggagctgtttatgatctggttatctccacattgttctgggaaagaattgagacattactgggtcaaatcatgtctgtgagacaaaatgaaaggtaaaaatagtgaataaaaagagaaagattagaaacaagctttagtcacttgctcttccttgcggtaggcccttggaatattgacaaatcctaaaataatttaaaaaaaaacagtggattttaatcaccatgagggtaaaaatagtcttgtttaccactgtatttccaacacatagcgtggtatctgaccctccctaaataattattgaattattgattgcacattttagactactatattagcatatcccacctctaagcattaccctgagatgtaactgtgcaatacagcaataaagggtgtcactgtgtcctcagtccaggcctaacacacagttgagctctgaacaacaatgtaacatcaaacagtgaccctgttgtaacatgttctggacttgtctaagctaaagttcaaatatgatacttccaaccctggttataatctctgaatgatgcattttatacatagcaatgacttttttattttttaaaaaagaagcatttaccatgcaagaaaaaggacaacattgcttcaagaatagtaatcagtcagtggcacccatcttaatgagaggatttacatcccattgttttcattttaaatgtcaatgtgcatacatataaacatttagaaaaacaggtttccagtagatcatgttatgtaaaggtcatacagaccttgcaaatattcctgcatctctaactaatctaatccggttcttgacttcaaatatcaaatgatatcccttactgccacccagaattttgaatgtctggtattgagtggtttctaaaagtttgactttttatatttgaagggcccacatgaagccatacgcaattagcatatgctgtattgtggcaagttctgttaacatcagctctttgattgaggaagaacactaactgttgaatcatcaaaacactacagcagtattttacaacctcagttatgcataatgtgaagtaatatgcatggcctgccctctgtaaatatgagaggcaatttgtttggctccacattttattttgctttcaggattatactacttactaacttcaacaaaagcaatataataagaaatattgcctcacaataccacagctctgtccatcaatagcaaaaattctcaatcttagcaccagtgccaggagatgaatctcattatgataattcagtgattgtatacggattcacatttcccagcatacataagagaatacaaaacaaacacaagtaggataagcaatcagataactgaagttttttttgtcaaagatattaaagagtatgttaagaatcatctaatgtcatctccctattactggaaaaaatggaagctcaggatttatataattagctctaggtcacacaggtagtttgatggtaaatcctagagaattctactgttcatatttcttaaacacatattttcttcattatactttatgtattacagtgatattagccactaccaagtcagcactaattataacttgatagatttaaaggtctaagctgaaaatatttagaaaattcatgttgagaatattgagaaataaggtgggatccaaggtggcatgaaaggtcagagtcttagtctgaactagaatgcatgcatgtaaggcacatgctagaaatttgtgagcaaaggaagaagtgagaaaaaaatgaatatttagtaaggttaatttgtaattagtctataggataaggtggagtgtagaaaccattctgccagggagatgaaaattagggaattgcatgtacaaattcattagctaaaataaggttctgttgtttgagtctctcaaaagaaatcacttctcaatagttatgtaaatactgaaatacaactttgaaaataatttttagtactagccatcaaaatttggggcttatgatgtacaaactgtgtgtttcaaacactactgatgggatctgccatcgaggagcccatgactgagattcctggtatgtgctatatctgtatatctgcctcctccaggaagatttgagggcctcagaaactttttccaaacgtttataacaaggatcctaagactattgccttcatagcgaggaagccagcaatgagctggatcctggacagcatgctggcccctgacatgggcaacaaattagatgggccacagaacctaatttctatagccttgactcaccacaggtttatgctctcccgcacaatggcattggggcaagtttatgtctttgtcgtgttgtgctgtttgttttctaagcaaagggcagtctcctatctcatgccaaatttaaaattcaggctgcatgaaatcttagagatttcacttaagcttttgtgcaaattagttggtttgattgaatcagtgtatggtacagcctagtaaatgtcattcttatattcattcaaaagaatacatgcttctacaaatttgctcataaaattagcaatgaatactggtggagagtcacacatgggaaagagaaaacctggctataaatctcagctctaccactgactagctgagttaacacgaactttaagcccttttaactttggcttttctcatctgaaaaatgggcagaaaatgtgggattttgtgaggaatagaattaatactaagcaaaagttcagatccgttttaaatgtcagcaattatttttctatttaaaaaagtatatagcgtatgttcatgtatcactaaaaatcatttctgggacaagctgagacataccataattatgtgtcaacacctgaggtacgtgtaattaatgctagagaaggtcagaagaagggagcttaacattggcaatttgctatttaggaagtgttccaaagaaaaagtgggattgtgatggactatggaactcagattagtaagacttggactaaatgaaagacatcctaatgattcaacaggactaaaattaaatatggaattgagcaaaagagactgagtgttaacatcctagaaaattgggaaaatattggcataatcatttgcccatgggaaagcatatgacatgtacttgcatacacatatattccatatatgcatgcatctctgtgtatgtttacgtacatatacatatcatttgcactcagaaaacactattactaacactacaatcatatatatgtggtgtgactatacaattgtatgattgttttctttgaagttcattaaaatcacatatattacttgcaaatttccgatttatgtacatatgcatacctcttaaaatgggatatatagtattccatctaataaagatgaaatttttgtcaggcttggaattcaagagatcttccttttatgtattatatttttactcaaatggaccactgctagttaagtttctttcaagttttctctgattcggtaaatgccatttgaggagttcattaacatgcgtttaaattcaggttccagtgcatgatgacggtcacatcaggccatggtgaaacaggaaacacatgaagaggctggagtatttttttttaattatttcattttttaattctgtgatcaggtccttccaagttttggtgctgatagggtctttttcttttatattacaatggtgagaagccctaattagcaaagtaagaaaatggcaactcaaggttgatctctggtttgtttctaacttgttttaaatttagttgaatcatgaagtctaaaagtccagagagcacgaaactaagctacattaatttgaacatctgacataagttagactagtatttttcaagttgtattctatagagctccccaattaaattcagcaaaatgatactggtattgtaagtaaaaaagaaagtaacaacctattacatttctttctttgtcaaaaatatgtaatctacgaatcattggggtgagcatcaatattatatacatgggatgaaaatgaatttaatttcattaggatcaggctttaaagatctaaactaaggctgtttgaatttttctttttaatttgataaactacaagttcacaggaagtttcaaaaaattgtatagggaggttgaaggtcctgtgcacccttcacggaggctcactcaatatttacatcttgcaaaactgcggtataatatcaaaagaattgacattggtataatccataaaccttcttctgatttcaccatttatgtacgtatacatttgtgtgtgtatgtgtgtgtgtatatatagttatactcaattttaccacatagatcacttcacgtaagcacaacacaagtggtagatgtaccatcacctcaagacaccccatgttatccttttataggccacctgccaccttcccccaatccatatcacattatgctgagtgaaataaaccagtcacaaggggctgcatacagcatgattccattgacatgaagaccaggtcacccaaatccttagagacagaaagtggtttcgtggttgccaacagctgggtgagggaggagtgtggactaactgataaatggatacagtggtgcctttggggtgatgaaaatattttggaccaaaatagagatgatggttgcacaccatcgtgaatgtacgaaatgctattgaattgtacactttaaaatggttacttttatgttatgtgaattttacctcaatttaaaaaatgcaacctcatggccctctgactgtccatgagagaggccagacttgcagggcagggtctgcagtttcctgagaacccacaagcagacacgtccttatgagatgcatgccctggaaatttctttcacaacgtgtttatgactcctggacattttgggctgaacagtcacaagagaagctagtcatgctcaatcatattttgcttccatggcattttcccaccctcagcctcctactccttttcatagacacacacacaaacacattctgctatatctatggatccagcctctgagccctcaaggtggaggagttcacaagcgggcaaccactcatctatttgccataataatgttacttcagaaatgttacacaaatagagaccagatgcagtggctcacacctgtaatctcagcatttcgagaagtcaaggcgggaggatcgctggagaccagggatcctggtctgtcaccatagtgagaccctgtctacacaaaacaatttttaaaaatgggccaggtgtggtggtgtgtgcctgtagtcccagctattcagaaagctgaggcaggagtattacttgagcccaggacttcaaggctgcagtgagctacaatcgcaccactgcactctagcctgggcaagagtgagaacctgtctcaaaaacaaacaagcaagcaaaaacaaatggaaacatgcaatatacattcattttagattgttgcttttccttttttacatttcaacttttattttacatccagggggtatatatgcaggtttgttacaagagtatattgtgtgatatttaagtctggggtacaactgaagtcatcacccaggtagtgagcatagtacccaataggtagcttttcagcctttgccccttcctccctcccctcgattgtagtccccagagtctactgttctcatctttatgttcatgtgtactcagtgtttagctcccacttataagtgagaacgtgtggtgcttggttttctgtttctgtgttaattcgcttaggataatgtcctccagctccatcaatgttgttgcaaaggatatgatttttttctttttttattgctgcataggatttcatgatgtgtatgtaccatattttcttcagccaatcaaccattgtgggcatgtaggttgatgccacatctttgctattgtgaacagtgctgtaatgaacatcccagtgcatatgatttttggtagaataatctattttcctttgggtataaacccagtaatgagattgctgggtcaaatggtagtccttacttttagttcttcgagaaatctccaaactgcttttcacagtagccgacctaatttacactcccacaaacagtaaagtaaaaaaggacaaagaaggtcactacataatgataaagggtgtaattcaacaagaaaatttaactatcataaatatatatgcacccagcattggcacaccaatgtcctaaatcaagtacttttcaagacctacgaaaacacttaggaagccacacagtaataatgggggacttcaacaacctactgatagtgttagaccgatcactgaggcagaaaactaacaaagaaattctggattaaatttgactcttgaccaactagacctaatagacatctacatactactttacccaaaaccacagaatatacattcttctcatctgcacacagaatgtactgcaagataaaccacatgctcagccataaagcgaatctcaataaatttcgaaaattgaaataaaagcaaacaaattcttggaccacagtggaataaaaatagaaatcaataccaagaggacctctcaaaaccacacaattacatggaaaccaaacaacttgctcctgaatgacttttgggtgaacaacaaaattaagcagagattgttattttttttcactcagtataaattacaccaggtttatccaatagttaattcctttttattgctgggtaatattccatggtatgcatgtaccacagggtttttttttttttaagcaattacatatcaagggacttttttgtgtgttttggtactataaggctgctatgaatatttgtggatacgtttctgtatgaaaacaagttttcatttttttaagaatgattaagagggcaattgctgtgtcatatgctaagtccatttttagtttgaaaatgaactgccaaactattttccagtgtggctataccatttaacagtcccaccagcaatatatgatttacccagtttctccgcttccttgccagcatctggtgtctattttcttattttagccattttgactactaggtaataatatctcactttggttttaatttccattttactaatggttgttgatgttgaacattttttaatgcatttatatatgccatctgtatatcttcattggtgaaacatctgtgcctgtcttttgtccattttcttattggatttttaaaatgttgagttttgagagctctttatgtagttttgatactagttcttgatatctagatatatggtttgccaatattttctcccagtctgtagctcgtatttcatttttttctttttttgagagtgcagtggtatgatctcgactcactgcaacctctgcctcctgggctcaagcgattctcatgcctcagcttcccaagtaggtggtactacaggtgtgcgccactacgcccagctaatttttgtatttttactagagacagagtttcatcatgttggccaggctggtctcgaactcctgagcgtaagcgaccagcttgcctcagcttcccaaagtgatggtattaacaggcacgagccaccacgcccggttatatttcttcttaacagaatattttgcatagcaaaagttttttattttaatgaggttcactttatcaaaatttccttttatggatggcgactttggtgtcaagtctaagaacactttaacgttagatcccaaatatgttctatttttgagtaagttttacagtttaagttcttctgatgtttagatcaaggtgttttttgtttgttttttgcctatgggtgttggattactacaacaccatttattaaaaaggctaaccctccttactggattcctgcttcgtccaaaacaaagggacacaaggaaacttttccagggaattgatgtttgttatttgattgtggtgatggtttcacaggtatatgaatatgtccaaactcatcaaattgtatacattaaatatgtgcagatttttgtatatcaattatactttaagctgtaaaaataaataaattgggcatatttgtggatctatttctgggctctctattctgtttcactgatatatgagtctgtacaccaccagtatcagactgtctagaatactgctgctatataattaactttaacaacagtaagagtgatttctctaattaatttttccttattcaatagttttggctagtataggtcctgtgccattctatacatcctatataatttttataataagcctgtgtaagttcaaaaacattgctaaaattttcgtaagaattgtcttaaaaatagatcaacttagagagaattcacatctttactatggtgagttttccaatccatgaacataatgtatctccatatatttaggtcttctttatttattttactagcacttggtaacttttatcatacagattctgtgcatgttttgttagttttatatgtaagagtttcattttctttgcagaaatcataaatgctattgcattttttttttttttttgagacggagtctcactctgtggtccaggctggagtgcagtggcgcgatctcggttcactgcaacctctctctcccgggttcaagagaccctcatgcctcagcctcctgagtagctgggattacaggcacacaccatcatgcccagctaatttttatatttttagtcgagacagggtttcactatgttggccaggctggtcttgaactcctgacctcaggtgatccggtcgccggggtctcccaaagtgctgggattacgggcatgagccactgcgcctggcctgacttctactttaaaattcttgtcagataatttcaacatctaatttatctaagtgatagcattagtcgatgtcttttctcattctagttttgtttgtttgttttggttctcagtatgcaggcgacttttgatggtactctggacattttgtccattatatatgcagaatctggatcttatttcaatcttttattttagcaggtatttaccatacgtagttcaatacacaggtgccattctacttttatgggctgtggtcccaaagacagttttattttcagagtatttctcgtgttattgaggcctgcttggtttatctagtgatgctggtactctcaaaaatccttgatggtacattctgagtgggcagaaggagttccccagactagggtgctggtgctgctaggtagagtaggggtttcttagatctatagagataaaagtgtttcctagataggattattgtgttagaatccctatactggtaccctccagctgctccaatgtctctgggtaaaagtggagggattctcatggccatagcgtccaacgggcttcccaggctagtcactctttgtggtggatagccttaccagtgctctgtgtttgcccaggtatctctgggtggggaagagaagtcctaggtccatatgaccaaagatgctttctgaaccaggtcacttattatgattgtgtctcttgtaatttctgcctttccacctcgatgtcttcctgtcggaaaagagagcctcagttctgcaggtatgaagaggcttcagtagttaggacacttgtggcaagatctctgtgcctattgggaacagacagtgctttctggatgggattttgttcttgagggatccctcttctagtaccctgtggctgccccagtatctctgtacaatagagggcagcctcagacccacaggaacaaagaggcttcctgcactaggccacttagagtggtaaaatcccttgtggcagttgcacccagccacctaagtatttcctgttgtgagtgagagtgagtgagagtgtcttaggcctgtagggacaaagaggcttccgaggttgggccacttgctgtgacaaaattcctctaaacaatactgccacttgtctatttttcagcagagcatggtagtcctaaatccctgggaaaggagaggcacttaccctagctgcttaatgttagatgggctcccattcaatagcccttgccagttataccaggctcatctggtattgtctgagagactcctattcaattcagagaggaaactagctgggctgccttctgctactaggcttgaaagttggaaaatgacaggtgggggtccccatcttctgttggataggggcacatatgagaatgtgctgcagtttattttcctctagcgcgaggctctcaaagcagtttgcttttctctgactatcctttacaattttcttttgatggcctcttgttttgtttctaggttttattgttcttcttcactatgaggagcagggaaaaatcagtttatgccatcttgtccgaaatggaattctcagtcttgttttaatatgttttaacacgtgattcagataacttggtttttaaaatgtgcacaacttttaaaaagaaatgttccaaaagctaaatatacatttaattgtaccatgctgcgtgtagagtagctggtaactactgaaatcataagtacatgtcagcctttgaaattaataacaaataaaacatcaacttggtcaaatgcggtggctcacgcctgtaatcccagcactttgggaggccaacgtgggtggatcacctgaggtcaggagtttgagaccagcctgaccaacatggtgaaaccccgtctctactaaaaatacaaaaaattagccgagcgtggtggtgggcactcgggaggctgaggcaggagaattgcttgaacccaggaggtggaggttgcagtgagctgagatcgcaccattgtactccagcctgggtgacaaagagcaaaatttggtctcaaagaaaaaaaaaaaaaaacatcaactataccaagtgatgagtagaatgactgtactaggtatgttcgttttcattgtatatttagtatttatttaagcaacctaactaaaaatagtgccgacaataaaaatatctcaatttacagaaatatataaaactttaatatgtagattgtattttattatttaattttatgaaaacatctgtcgaggccaggtgcggtggctcacacctgtaatcccagtactttgggaggccgaggcgggtggatcacaaggtcaggagattgagaccatcctggctaacatggtgaaacctcatctctactaaaaatacaaaaaattagctgggcatggtggcgggcgcctgtagtcccagctactcaggaggctgaggcaggagaatggcgtgaacccgggaggcggaggttgcagtgagccaagatcgcgccactgcactccagcctgggcgacagagaaagactgtctcaaaaaacaagacaaaacaaaacaaatctgtcaaaattatgcaaacaaaaatgtctaccaacttgaaattacagatgagtacatgactataattttatatatatatataaaatacacatataacatatgataaagtattcattaatcatttatgtctctagtttgaacaacacagggagttcaacatgcacctagcacactgcgtaagcctttctatagatgttttagccaagatcaagactgtctattaataagacatctaaaacatttaatcaagcacatttggtttgaatataaaaagatgatagagcaatcaggtttttctcaacaattagtgttttttaacaaaaggacataacagtgcatagccaaaaatttattaatttttggaacttttagtttccaaattcttcttcattaaacacaagataaaaatacttaactttttaagacaggtgaatagaaggaaatttttgctgagcctcttctactttttatgttaaatattttattctatgctttttatcatggcttacacaaaccttcataatgttgctgcaatatatttactgactatcaatgctctcttcaaatttggtataggtatatttttcagcctttcccccttcttgtctccagttacaggcccttttatgggcctataacgttggttttctatctcaattcaaaattcaaaagaaaagactttaaaaatcatctttttttttttgccctaatgcttaatttagagcgtagcacatagatattcccaatatgttctcattaaaggtattgatctttgatttttaaaagtaagtaacaacaaaactgtgagagaggagcagctttttcctttgagaactgtggtttaaatgcagtgaggggtattaatgactacataaatgacttcctatttcagtgaagtgtttaataaggtctttaaaacagtacttcatagcatcctgctcttcaaagcaacatctgtggctctttttggttccaataagtgataaataacaacaggattttggttcacgtaaggacctaaaacaggagagttggttaagctattcatacatgttgctttgtaattgggctgatgtaattttattttattgtgttcaaaatttacactggtattttgtcaattaccttttttctcaacttacaaagtacatttttaaaaaagaaaaccatatacaaagcataggttgtgtaatataatgaaccagtcattattcttcttatctctctatttaaatcatagatttcaaaaagtttaatacgaattcatttgtgtgtgtgtgtgtgtgtgttataatgtagtggagaagcaaacttgatacatttaatgctgtaacattacatattgatgcattcataattcaaagtaacatgatagaaagaaacatacatgtgaaggcattaaaaacatttttgtttgtaaggattttgaaacttggaggatcaaataatataactcagaattctttctgtcaaaataatgtggaacaagaaacacactaaacaagagatatttgggaagttctactcagtccataatttttctcccttctctggcgactatcaccctccagtcaaacaatccataagcagagtccttgatatcatgtttgtattgtgtgatatttgcctctaggacaaggctgactggaccaagattgaggcctgattcaacttggaacaaacagatgcacttcctaaaatactttacctgagactcataaaatgagaatttgtgcaatgagtcattcttagtagcataccactatggagatggcctatggccccatcattcccatggcctgtaggttaaatttttcttgggttctaccagtagataatccagagtatgcacaaatacaccttgaattttgaattgtattttgtttgggtttctgtttcttgcaagaaagaaagacattattgatatttacaagatgacttaaaaatcaggtatattctaaaagaaaagatgagactacttgagataccaaaataaacagggaacaaaaatattaccaacatattatcgtgatgtagataggatttttttcaagaagcttgagagcatattagtattgcatttggtacataatctgaataggaccatacgataaagaacactgtacaatgttccaccaaagtataccttaataacaacaatagcttttataaaaattcttgttttatatatctagaattttacataaatgtaaaaaataatgtagatgttatatctcatttaaatatcaatataaaagttaattggctgatacaaatacatccaacttactcaacttatttattttcttttgagaaaggtaaaattagagaagtccagagacttatacaatgagtacatatctccaggaaatcataattatgaataatctgtcctaatttattgtgcataatctaattataaaagaaaatgattcaaatacatgtgaaaacactttacttccttatctccaggcctgttctcctgctctcgtctttataagaggccatgatatatgaattttatgttcattaatttagctcaattgttctgcttttcacatacattcctatatccataaacaatacataatgttgttgttgtgtatgtatgtgtgtatgttctttacaaatttacttgagtgcttggcatccttcattgagctaatgagctatccataagaatccatgttgatccactccatacccaggtagtatcgctgacaggctgttcagcctctaattgtattatatagctcttcttgcatgcaggtgtggttatttgatttgtttctcccagtagaatatgagtggaagtaatttgtgtcaattcagagcttcagattttaaaaagctaatatatcttctctgctgtttctttcccattctatggatgtatgcagatgactctgaggttgaagagatgcgggggagcaacaaaatggaagacgtctggatccttgcatcgtcacatgcaggaaagcaacacgctgccatggaatgccatggactgtgacatgagcaaacaataaatatctgttgtgttaaggcactgaaattgtgggtttggtttgctatgctagctagcattaaaagaatgaatatactatcacgctttgcaatcgttctacaactttcctttttcactcaatattatatatttgggttacataattattgtgagatatggatctaattaatacagggtttttcaaaagtggcacttttaacgttttggactgataattgtttgttcgggggaggccgtcctttgcattgtaggatgtttgccagaatctctgtcttctacctactagatgccagtacaatgctaccacttccgcagtaattacgataaaaaaaactgcagacattgtcaaatgtcttattcatggccaaactcatgcctggttgagaaccacttatctaatacactctttttagctgcttgatagtatttcaccacaggcatcaaggatatttattatatttttacactattgaacaatgaaaatccttgtaactgattttgagctgaattatgatacccatactagctgcttaagaagaagaaatgccttttcttcaacatcaataaaaagtaaagcataaaattatatagatctgaaaagtaaggaacggttaaaaagacaggagtagaatgtagagcactaggccagtgcaaaaatagaagctgaactctaaactgggacacaatcacaccttagttgttaatttaagtaatggatgcttctgagttaggaatattagctcactcacaccacaatccatcatcaggcaatcctttatgattcttaccttctccaaaacaattcctaccattcaactcatctgcaaagcctgtcagtgctccctgcaaataatacttcatgtgaggctactttctttccttcataagtgccactacccttgtcaaagccaccccgcaaaagtgaaagagcctcctcgaggtgaatggctttccagccttctggaaagctggctgagccactgatgatgatgtggcctttttattctaggtttagtttaaggattataaaaaaccagatatttatataaatattctcttgaatggaagcacatagatgattagttcaaattctttcgaagtggtgatgtaatatcccagttgaacagggtaaggtaaaaataaagattttactttctataactaggcagatctcacattgggcctttagtgtcatgggtgccattccactgggaaatctgatggaccggggaagccatatttccgaataggttatctgttcctatttatgtggtcatccagtttttgaaattttttaactaaatcaattgcaaacttcatctaaccttattgtatagataaacacaatttacttcggccaacctgtacccaacataaaactctgtatctcctgagatcttgccctctctatattcttctcactgcaaacagcatcagagtaatgcccaagtgtacatcccattgtgacatcccctcaaattgttcaatggcctcctattgaccttaggatgaagttaaaacactctagattcacaggtgtcccgtcaaactttcctgcctcatttcatggctccacagatgctggcctctatcatttccctaagttcgctaattcttcgaagcttaagagccattgtacatgttatttctctgtactgaatgtcttccccttctctctccctccaatttttatagttcagaggatctcagcgtaaatatcacctttccagaaaggtcattagaacattaaggattgtaaccaagagacaatagctgttggttttattttttattcttgtggcatatgccaactaacttgcacagtgcctaaagtcgaaaagggctcagttactatagacacaagcaaatatgacctgagctaccaacaaaattacatccgaagacaacaggaagacgagactgtgaggtttccaagtttatagacaaggtcagacaaggaagtcattaggctcgtctctgtcaattttgaacaacaaagttattatttctatcttgcaacaacaaaatatagtttttttaattaaaaaaatcttcatttaagaaattgctgcaggaaaataactttgaattgcaagtataaagaaaattttctgagccctagatgctctttttttcctttgaaaaccattattttcaaaggaaattgttttaaaacataattttttaaaataaggtgtaaacgctcattcacagaagagccctaagtcatgctacaataaagatgtaagtagaatatgggatttgagtcattttttcaatccaaggaaaatttcagaacaaaatatttttggaggtgtccaatatttgtttagtttcacacagaaagacactatttacattcaatatattttaaaaactgtacacatgttctataagattatcaataccaatttactcatttttcaaaaactattttttaagtgtttgtttgacaataagaaaattcttttaggtggtgtttcaaggaaggccacacattttaacataattctaagttgaggtgaattcataatataagacattttgatatctgtcaacaaagactctttacttgaagaacagtcattcaaggtctgtgtccttaaatataacattccagatagcttttaatttcaagtcttttatttccaaaagattttctgtggattatctattatagttactaacaaaataataattcacaccaggcaattatatcctggtatttgataaaacttggatgtttaccatttcaagaatgatttcctgaaaaagaaaaagaaaacagctgatattcaaagtcagccattttctgcagaatgagcaattatttaaaaggaaataacttttaaatgagcgcatatattccaggcacatattttctgctgcttactgaacaagtccacttcaaacataacatgacatgaataaaaaacaaaagaaaacaaaacgaattccaccccaaatgtgctcctccttatatatttctcaccttggtaaatggaactactatttattaaacttctcttgtcagaactttgtatcatttaagatttctgtcttcctcaccttcatttaatcaagcttcaagacacgtagattctaccactaaaaagtgtttttaaacagtgtctattgttactattctaatcaaaatcatattacacttatgactttataagtactacgacctcctactggtctttcatctttcctcagcctgttgatcctccaatccctatataagtacctctattcccaataaagtctctctgccacatgaactcacaatgagctttaaaaagataaagatgatgatgttattccgtttgactaaatctcataagcggctccttatttttttggttataaaatccagaatgctaaacacgaactataggatgctgcatgaggtaatccctgtttacatatctcccccaacccatgttgattcattcatctttcctcattctagctgtgcttgactttagttcctcaaatatacttgcttctttatgtctcaggtctttaatacatgcatgctatacaagccagaaaacatcttaccaccaccctcaagtaatataaactagacaagtgcatacaatgtctttaattcctggtcaatttttatcttcaagtgaactttactataagtgaaagcttttgtttgcttgatttatacatggtcacaaaataagctgccagaaagtcgaatttctttcctcctagcttaaaaatacatctacccctccttcatccttaaaaaagaaaatgcatcttcataaaaagattacaacttttgaatataaaagtcatgtttttcaaacaacggatatattctcaacatatatgtatttcccaccaattatgagacacaacaaaaaaagaaaatttcaggccaatatccctgatgaacatcaatgcaaaaatcctcaataaaatactggcaaactgaatccagcagcacatcaaaaagcttacccaccacgattaagtcgacttcatccctgggaagcaaggctggttcaacacatgcaaatcaataaacataatccagcacataaacagcaccaatgacaaaaactacgattatctcaatagatgcagaaaaggccttcgataaaattcaacaccccttcatgctaaaaactcttaataaactaggtattgttggagtatatcttaaaacaataagagctatttatgacaaacccacagacaatatcatagtgaatgggcaaaagctggaagcattcactttgaaaacccgcacaagacaaggatgccctcgctcaccactcctattcaacatagtattggaagttctggccagggcaatcaggcaagagaaagaaataaagggtattcaaataggaagtcaaattgtctctgtttgcagatgacatggctgccatttatccccatgtaatgccttctaatcacactgatgttctcgttattttgtcttgaattaaaaagtctttttattataataattattatttcactggaaaaagctacatataaataaaaagagaaatacttataattttattgccaagagatagacacccaatttatttgaagactatttccaaacgacagttttttctgtgtctccgtcttcatctttcccacattctgcttcgatatatgttaccctaaaaatcctactacatatattgttttgtaactcacttgtaatatttttcaatagtttctggccatgtttctacttttatatactgaaacaattcaataatttgatggctgcataatttgctattttataaatcttatataatttatttgaccacacttgtattagggaataagatgtaacccatttgtatattcatgcaaattatatatgccaattttaacatttaatacacattgtccacattatctcaagcaaatttataagaatgtatgtattccactactaatactgcacaagactttctattttcatcaatcttaggagtaattaccacggtgggtttgttttcattcccttccccaaaacttccgtaacaatctttggggttttgtcacatctcccttcacacctacatcacctttaaaaccaagagttaggactcattttggaatcatttttttatacagctcaaagtcagttacattatatttagtaccattagaagatacaaattttcctcaacactttctgggtgttggaacctcaaaactattttaaaagagtagcgaagataatatctatgttgaaatgaataaaatagatctatcatgaatatcatgttttataaaacagaaatgtatcaatgaaagatcataagttaacactttaaaatatatgttatttataaacagatatacatattcggaagatcttcaaagtagtacattgattcttatccaaatttgatttgagagctactggttttaaatttgtaatacaaattacgatggggtgcggatttcctaggccagttttttatgtacaattgaatgtagaaaatctacaaaaaaatagtaggatacaatcctggattttggattctggagacagtggaccacattgtataggtgattgaatgaatgaaatgagaagatatatagatgaagaaaaaaaagaaagaaaatatacaaaggaggagatgattggaggaaaaacagatgccaggacaagattctgaagtatatatttttggttttgcttttatccctcacctattaaaccctgtttcatttgactcctactctattttctaacctcatctcccattgttgctcttaccattgccctctctactccaaccacacaagtcaatttttctgcttctctttttttagtccattcctccctttgtgcttcctgtttccctatatagaattctgttatccagatcatcacatgtataggtctgtctattatctcatgtatcagctcagctatcactgcttcatagtggccttcccttttctttgaattgagaagcccttaaatccagattcactcactataggttatgtgattatccctcaaaatcatattctttaaatatttgatttttatcttttctcactagtaagtatgctctgtgaaaaccaggcgatgtctctttttcaccctagacctgtcagtgcctaatatagtaccttggctatagcaggttgtcagtgactcttgcattcattgagattagaactgagctacaagtgacagaaaatccaaaataaccaatatcaggaacaatggaagtttgcatctttctgaaataagaagagacagttgagaggcagtacagtggctccatgatcatcagggacattggacaatttatattattagtttgtcttcttcaacatacaacttccattttgtagtccagatggctattcaagctccaatcatcacattgccatccaagtaacagtgagaaataacaaggaagataggggaagatggacttctcttcctagaagtttcacacattaattcttattatgtcctatcagaaccaggtcacatgatcatacctagctgcaatggaggatgaaaaatttaaactttattgtaggatgttcatttaagccctctctcgatacctgcctctaggctaaacatataaaaggaacccgtttctcactaactcaccccaaaccaataattcatagtgtagctaatattaagtatgtgtccaaaaggtagataactgcccaaacgttttatattcttcctcaccaagaggtaaagggtcaacttcattcttctgcatgtgaatctcaagttttctcagcaccgtttgtttaaaagatgattctttctcattttcatggtcttagcctctccctcatttatgagaggaaggatctgcgctaggtgtggtagctcaggagatacagaagcagccacatctcttcagctatgaccagacgtggtgataagccacagcagcttctgctgataagtaaaaagaagaagagaatcacgtagaagaagcaccctgtttttggccatgtctatccagagtaaagtttctgtcacacagagctagagagagtggggttggggtggggattgttgctcaaatgtcattaactttcactgttctgactgagattttgcaggtttttttgttttgaataaatatttctccatttgctatatgctcttaagaccatttccagagactttccatggttattttattacaattttcaccagttacagttgttttactcgggacagcatccatggagcccctgacactacacactaccatttcagaagtgtttctctccaaaatgttcatgtttatatttcgccatagttttttagttaatatttcacaaacttgtaaaatgtgagtatcttcaccccaaccttcaggactgcagtggcagaggccatgaataggaggtagagtagattgatttagttttaatttagaaaaatgaactcatataagtaacaattgcaggtaaaaattaggatttagactttgcatttgtaggctctgttttcttatatttattaagtttaatatatttgatactaggtagtaaaatgtttactaccgaaaaaaaaaacttttgccaaaatgtgtcaaattttttattttatagcaaatactcttctagttaacatatattttatcttcagtgcccagttatttcagcttcattaagagaaaaaaaaaagggaatcaaagagtaatatagtgcctttttgattttaagactagctcttattacccttggcaatagattatagaaatcatacaagcagtatatacaatttcaaagtcacacacaaaagtatattcttgaattatttaaaaagtttcaactcacaaatattcactgtagaaacatacaaaacatcgagaatttaaaggacatatgaaaacaaccagaaaagagttaaagcatggattacgtttagttttacaatgaaaagcaacagagactttgaaattaaagatttactatggattgtgaaagctgaatgctaaatcttaaggaattttgagggcatactattaaacatagcccttgttaaaattaaataaacttatgattaaataaattatattaaagcaactgtaataaatgttcaaaactcatcacttcttaattattttactacatttcactgtcgtctacacttgtgaggttatttgtatccttttatctgtatggtgaaaatgctatataataattggccactacctatctcatcccagctccacactcagcaacatcatgttgatagcttgaaactggatgtggttgaagtatttacaccacagaaataagcaaacactaagaatcatagcttgagttctttctcactgagctggtggttaaaatatacctacacagtacacatccccaaagagacatatatagagagatacagacataagtatatataatataaatatatggagataaagataaatacaaatagtgacatagatatgtaaattcagctagctatatcagcaaggtaaatgagtaaaaactgaaaattcgtcagcaactcaagttatatttttagtaaaaataaagccttgttctaaacaaattcagaaacaaacacagagactaaccagtgacaactggttatgcaataaacatcctgacaattgcggtgtgcaataaacagacccacatctaccattatttccacagggatgttgtaaatccattcactggccaaacatttactgagttattgactactccctatcagtttctgtgctatctagataaaacagtgagtgacaaatagtggctatccttagggagctaaaattacacaaatggacacagaattctatcaaccgtatgacaagagacatccatgggggatgagctaatatgtgatgacaaactattttgtgacaaatatgatactaaaatatttatttgcattatctcacatatattctatatgaattctgatatgtaactatcatttcttcattttacctatgagatccaggtaagttaaatcatatcacattatttagattctatatccaatcagctgttgacttttatccatgtctttcatagctttattggcttttctcctagtaatgctttctcttgtgaaaggtattccatataattattaaagcaaggttattccaagttaaagtaatccattgtggtgatgtctcccacatgaaacatcactgtctgaatggagcaaactaaaaaataaataataaaaggcagctttttaaatttaggtgacagagcacaagcagattctataaattatagcagtttcataaaaggtaaaatcccaagaaaacctctcagaactattcacatttttgaatttatgtcttctagggtacactgtaggatgtagttaaagaagaaaaaagaaaaaaataagaggtttttcaatataatatgaattccagttttatcatgataggagaatatagactgtaggaagtataatggtaccagatgcttttatttgtcaattattactaaattttagaaaaaagaaaaattctagtttttgagtcttccagactgagcacccatttgacatacaatttaacttaccaaaatatgatagctacgttatgaagctagacacaatgatatgtttcaaatgtataataatcagaaatatcccattatttggttttatataacatatacatagcccatatgtcaaaggaagacacaaaaaatagttttagtacctggttgaaatttttgattaaaaaatttagctgatccttgagaaatttaactgaatctaaacttattcacaaaagcttacattcactttggcttatttgatgtttagaaaattattttaatgattttattcttgcagcatttgctgaatagtgttattgttaagaataacacctctgaagtgatacttcctgagatccaatacacttactgttttagataacttacgctgtagttttcatctctgtagatgaggtgggatacactaatacctacttatcaagcagtctgacaagttttaagaattattatgtccaaattaaatttaaaccaaattaatagtatatgccaaattgtgaatgtacacacacacattagtgtacataattatctttttttccaaaaatatttaagtaaaagaacataaagtttaaaaatagactttgatagtagacagactttttttttgatgaattggtaatattcattcttgttctataattttaaataaaaagtttgtctcattgtatctttaaaaatacgtgttggtgaggatttggagaaaaggaaaccctcatgcactgtttgtgggaatgtaaattggtacagccattacaaaaaaaatagtagggaggtttctcaaactattaaaaatagaattaccatgagatctagcaatttcactgttgattatttacctgaagaacatgaaattagtatctcaaaaatatatctgtactctgacatttattgctgcattattcacaatagccaagatatagccacaacctgtgtttgtggatgtatggatgaataaagaaattatggtatgtatacaatgaaatattattcagccataaaaagaaggaaatcttgcgatttgcaacaaggtgaacttggaggacatatgctatgtgaaataagggcagaaaaaaatgaaagacaaatgttgcatgatattatgtgtggaatataaaatgttgaacttatagaagtagggagtagaatagcggttgccaggagtggtataaatggggagttgttggtcagagagtaggaaccttcagttatagagatctaacgtacagcatggtaactgtagttaatattaatgtcctttatacttgaaacttgctgagggagtagatcataagtgttctcatcacaaaaaaaagagactactatgcccggtgatggatatgttaattatatcaaaataccgtgttgtatatcttaaatatatagaatgtttttatttctcaataatacctccataaaaattaacaacaaaaaagtatccctaaatgatttcaataacatatcattacagcagctacaaaaaggacaaactgatatttagccacaagcatgtgatgatcaactgattttcactattaagttactgttctcttaccgtaagaggaaaatagttccttcatgttttaataatcccatttcatccagaaacacagagataattccctgtgttagccgcacatatctcaattcttactcaaaatttaattaatcttcagtgatggaaaacaatttccttctattaagaccatatcattgctgaacgtctttaatttcaagaaccattaacaaaatttcaaacaatttatgttatttaaaatagaagctgaaaaaaggagaaaactacacaaatattttaccatcacaacaaatgtgaatcacagattcaatatgtgattcttaaacacatttcttaaatatgtttgctgttttggctgcaaaacaatcgtcaatgttgagcgtatcggacactttaggaaaatctttagtaataacaaattctattctcttagtatcttatttcttgctgatactctgtgcctatcctaataagcaggggatggctacatactgtaatcactcaggaagataaaacagccaacattttgagtgttgttggtctcaggaagataaagcagccaacttttgagtgttgttggttgataggtctgagagaaaacagaacacagtaaaacattcaatggctcttagaacatctgtccaaaagtgacacagttcacttcttcgcacatttcattgatccggcatgtcacacagccagactcaacttcaagtgagtgcggaagtgattccacgtaccagaaaggggacagaagcggaacagctatcaagagtcttaatgtctaccacctccacctgtatcagataaccacaacttcacagaatatatttcataataggtacagagaatacataacttaaatgaaactcatcattattaaaaataaactttccaaatattttctctatttattttaaatgtaattaaatctttataagcaaggtctgcaaatttttattctaatttttttttcctgagagtaagtggttattatgttactctatagttgaaaaccaaaatgagagaaaagaaaaatgacataatcagagttagagagatataggtaaaaaccctgactttttcttttggtacttgtaggactttgcagaagacttttgatctgaatggcagtaagtttcctcaggaaaatgaaattaatatcatctaccttaaataggtggttatagtgattacatgagctaatgtttatacaaatgctgtcttttactccttcccttcttagcttctatttgaaaaaactttggtaaggagctgcagcttttcaaaggggccataaacttgactccgtgcagattctaaggaaggcctagtgaggaaagatgggctaggtagttgcttcagttctctaaattatgtgcaagaatcttaaaatgaaatatgcaagaaagatacagtctaggggtggacaggtaaagaacagggagaggtaaaggcaagaatatttggctgaataatggaatatgtttttctagccattctgacaattggtagatgttttacattgtccttttttacatactgctgatattttcgactttaacttttcctccatgccatttttacaattacagtttgaataaattttaataatataaaagtctcttcttgaattttgactctctccactttcccattcaccttgatgtttccgatgatcctttaactgtggtagcagttgcacttaaatagcatgctgcaaatcctacagtgtgagagctctttctttctttatgttaaatttctaaactgtatccactagagacagctcagaagagacaatgaatactaatcaaaagagaaagaatcacttggttgtggtcacgccttagcaagaaacccctttaccagaaaagacaactgttttacatgctacctatatattcccagtggaaacagccacttcacaacgactttaaagtgaagatgaatgagttttatcattgcttttttgtggtgcataaactagacctgaaactatccagtattttatgattgttgcattgaacatgcaaattagcaaatattagctttgatcaaataccacagccacacccagaatgcttgtactagtttaaagccatcattggcaaaggccagaattctttgtttttaatgaagaacatataattcccataaaggcatgagattatcaggcacccatgtcaatatgatcaggtgaaaacttctggttcatcctcaactaaccttttcctatcttgctgatgaggaaaatttaatactaagctaactgtggagacaaactataactctttgtaatgtttggatgccatactgtgattgtttgtgtcttctcaaacttcatatgttgaattctaatcaccaagatgactatattataaggtagtgcctttgggaatttattgggtcatgagggctctaccttcatgaatgggattaatgcccttataagagaggcccaagaggccttggaagctcagtgagcgtgcctgcaccttgaccttgaacttccccgcctccataactgggagaaataaatttctgttctttataagccaccctgtttatggtatttttgttacaccagtctaaaaggactaagacactgatttggggaagattttggcagtaattgctgtctcttttacatactcttccccaatgtaaacttctataatctaatcaagggagtttaaacataatagccatgtaacagacacagtgtaaaatatcaaagattttttaagatgtagaaccagtcgcgttagtattgtggcttcagggacaatgtatttcttatagcaaagagaccaattaacaaggttcgataaagcagtatccatgcactcgctgtccttcagtattttgcatgaagccaaaggcagaatatgctagaagtagaaaagcaggaggttaaaataaccattatcaccaggaccctgacaccactcaaggccaggcattgtctgatttagggagaagcatgagtttccttccaagtggtattacctgtaaaaaccagggcaattcactctccaggtaaggccttaggaactgtacgtacacatttttccatctcaattttgcaagcacctcttcaaaatagtgtgtggataccctgcccactccaaacagacagaaataggtggctctctacataatgcttagaaattatacttcatggtatatttttttttaaggaagacatgccaagcataatgatcttatgcccttgtgaaactttttaaaattgtgaacacagtgtatctcattccaattcgattttacaaaattatgcagtaagttttttccctttgttgtaagaaaatatttgtgtcttagtccactggcgccattataacaaaatatctgagacaggtaatttataaacaacagaaattaattgttcgcagttctgtaggctggtgaggtgtctggtgaggacccagtctctgcttcgaagatgatgccttgaacgttgcatcctccagagagaagggatgctgtgtcctcccatagtggaagtgatggaaaaatataagagcctagttagttctcggttctcaccagcctttttataaggtcattaatcccattcattagggctctgccctcatgatttaatcacctcctaatgtcctccaccttttagtactatcatattggcaattaagtttcaacatatgaattatgtaggacacattcagatcatagcagtttgtaagataaaatacatacatgacacatttcatcatgtaagatattaagttttaatattttgaaaaattttattttaatattcatttttctacacacatatttcatagtattaaacatattggctatatatttttataatgtgatcaatttttattcatcttactaaatattcttgaaaacataattttaataagtgcttaatgttccgttgcaacagatatgccaagatttgtttatctgacccttatttttcagctacttaggttgctggtcatttccacttttcttaaaagtaacatagcaaagaataaccttgtccatactatttaatcatgtctttagggaagagtctcagaagacaaattgctgggtcatagggtcaaatacactctttatgcatattgccaaaatgctttcaaaaaccattagactgatttataacctcaccaacaagaaagggcatgcccacttcactgactcttctactgtattcaccatttctaggttgataggtaaaatttacataaaaataaatttaaaattaaaaactactgatttagttattctactaattccgtgagcatatcttcatatttcttgggcatttatatttcttttgcggtaagctatttgttctctttactctttccatttttctatagtggtattagtagtgttgcacattttttaaagaacttaatttttctagagtagtattagcgtcacagcaaaattgagaggaaggtacagagatttctcatatatcccctgcctccacacacgtacagccacccacgctatctacatctcccaccagacgggtacatttgttacaattgatgaacctatattgacaaatcattatcaccaaaattccatagttaagagtaaaggttcattcttgggtgttgtgcattctatggatttggacaaatatataatgaaatgtattcacaattatagcatcattacagagaatttccctgtcctaaaattcctctggactctacgtattcatacatttccctcacagcccctggaaaacactgatcttttaactgtctacatagtttttgctttcccagaatgtcgtattgttgaaatcatatagtatgtagattttttcagatttgcttgttcactggtttcctctatgtgtttttcatggctcagtagctcatttctttttagcaatgaataacatcttattgtctgaatgttctacatcttatttatccattcacctactgaaggacatcttggttgcttccaaattttggcaatgatgaataaagctgtcataaacatccatgtgcagggttttgtgtggacataattttcaactcctttggtattttacattttaaaattttaagttatgtggtatatataacaagccaaaataagcttagtttcagttaagaattatggttttaaaatcttctaagattaaaatgataaaataaagccaacattcttctttccaccgaagagacttacatataatacaaattcagaagttttatgtctcctagattacacaaatcctgggtaataggaatatgggatgggaagaattacaaatggattatgtagatacttactgatatggtttgtctgtgtccccacccaaatttcatcttgtagttcccataatccccctgtgtggtgggagagacccagtgggagataactgaatcatgggggtggtttccccatgctattcttgtgatagcaagtaagttctcatgagatctgatggttttataagggacttccccctttgcttggctctcattcttctccttgctgccgccatgtgatgaggatgtgtttgcttccccttctgccatgattgtaagtttcctgaggcctccccagccaggctgaactgtgagtcaattaaacctctttcctttatgaattatgcattattgggtatttctttatagcagtgtgagaatgaactaatacacttaattttttaaatgtctgaatatttatcatttcaaatttatttaatgtcttttgtttcctctcttaatataattttatcaacaaatttttccattaaatcagtgaatcttctgaagttatttattataaatatgaattaattcctttcaaatttattaatgaattttaatataatttaatatatgatgtaaaatgatgttatattttagatttgcttgtaacggtcaccaatatgtaaacagattctctctccaacaattagaaatctaaactatactacaaggctacagtaaccaaaacagcatggtactggtaccaaaacagagatacagatcaatggaacagaacagagccctcagaaataatgctgcatatctacaactatctgatctttgacaaacctgagaaaaacaagcaatggggaaaggattccctatttaataaatggtgctgggaaaactggctagccatatggagaaagctgaaactggatcccttcctcacaccttatacaaaaattaattcaagatggattaaagacttaaacgttagacctaaaaccataaaaaccctagaagaaaacctaggcattaccattcaggacataggcataggcaaggacttcatgtctaaaacaccaaaagcaatggcaacaaaagccaaaattgacaaatgggatctcatcaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggcgggactgtaaactagttcaaccattgtggaagtcagtgtggcgattcctcagggatctagaactagaaataccatttgacacagccatcccattactgggtatatacccaaaggactataaatcatgctgctataaagacacatgcacacgtatgttcattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagcaaaccattgcaaggacaaaaaaccaaacaccgcatgttctcactcataggtgggaactgaacaatgagaacacatggacgcaggaaggggaacatcacactccggggactgttgtggggtggggggaggggggagggatagcattaggagatatacctaatgctaaatgacgagttaatgggtgcagcacaccagcatggcacatgtatacatacgtaactaacctgcacattgtgcacatgtaccctaaaacttagagtataataataataaaatttaaaaaaaatgccaaatataacttcaaaaaaaaaaaaaagaaatctatacctaatttaggagacaaaacaaactaatgtcagaagtttgtttgcacacttctgtaattaactacaaacatatattcaagagtattctcttatcatttcattctatgttataaaaaaccttcagtctcataagtcacattatagagcattacgttttcctcccatggtgaaaaggattagttcttagcaataacttaagaacacatcttttgtcagtgtctctgagggataaatatttcctggttgagtgtttatgcacagaggaaaaattactgaagtctgtgcccaaatatagcttctgtaaacttgaaaaatataaaagagaatttagtgaggaaaggagacagagagtagctccttttggactataatacaaacacattttctaagaactaggccttggggatcataatcaactagcctgagccacacacaatggataggtatttctgactggcactttttagctgtaaggcatgacatgaaattgcaatgagagagctacaaaaaggccatagagacaagtatccagcttaacctttctccctatgcagttgtcttctttaccacagtgatgctggctggtcaatttagctcctgcttgaatacttactatgaaaagaaactcttgctttatgttacatgtgcatcattcatttagacaaatttttaatgcatttacttattgaagtctaaaggtacacaaatgaagaagatgtggttcctgatcttgcagtttccagtttataacaaggaacagaaatatacatgatttaatataacgtatggtcatagtagagctgaaaatctgaagctttggctaaaatgaggaaggagtacctaaatgggcctggtatttgctaaatgtatagagggaacaacatttaattgaggaaataagtaggagatttccactgatagaatggtagaagtagggctgtgatgggtgtgggggacatggaggggaaaggcaaatggcacagaggcttgaaaactcctggcatgtttgggtgagaggtgagagattctatgtggctacatcacagcaatataaatgtcatgttggaaagtgagtctggagaagaaaattggggcaaacaatccaaagtctcaattagtacaaagccatggggacccagactctgtctctgtaatactgaggacagatgcagcatagagtagatattacaacaagatactatggcgctaccctgcctaagtttcaatgtgctctcaaatagttggtgactttggacaagttgtttatccccaccctgactaatacatgctctatgcctcagtttacttatctgcaaaatgaggatattaatatttagctcattggattgttttgaggagtattggacaaaattcttttaaagtatgtaaaattatatccttttaataacaacattgattaaatagattccaagtatgtattggagcagagagagtccagatgatgatccctgaaatccagcagtggccaaaaataaaagaggagagaagaatgcatgatcattgcaactcgagacagatttagctattagaaagttctttcttatattacacctaaatttgctctccttcatgcaaagaattcaatttctactggctggccctatttctaccttccacctaatagacttacatataataaaaattcagatgttatatttttcccagattatatcttttttaattttgtaaaaataaataaataaataaaagagtttgacatttcactcacgagtcatccttagaaagagtaaaagatcagaggctgggcacggtggctcacgcctgtaatcccagaactttgggaggccaaggcgggcggatcacctgaggtcaggagttcgagaccatcctggctaacacagtgaaaccccgtctctactaaaaatacaaaaaattagctgggtgtcgtggcatacgcctgtagtcccagctacttgggaggctgaggcaggagaatcacttgaacccgggaggcagaagttacagtgagccatgcgccactgcactccggcctgggtgacagagcgagactccatctcagaaaaaatataaatatatagaaataaagatcagaaaggcccattgtaagtactaatggttccagtgagatacagcaggcagcacagtaagcagcgcctctattgttagggtagaaagcagtcacaggcagaaattcaataaaaataagaagaaaaatattttagagtccccaaatcctacctccttcaaaagttactcatccaaaatcctttttaaactgtaacattctgtacagacaccagtttttcaaatataattgctaagatgtgaggcataaacataaatctaaatttcattgagtaccacgtaatgttcagctattatcatacttggaaacacatggataaaatgaatgttgaaatagtcatgactctggtatgtctaccaatgcgcagttgatttatactgtcatttattgtgaatgtgccataaatgacaagctacttatgacattgaattgaaccattctttttggaagtctctatgccagacattgttctaaaggctaagagtttaaaagattcaaaaacacaatagttccctagtttgccttccttcctacatgtccttgcctgctctcctaactcctaccccagtctttgcccaactttggcattttcccaagaaagattgcattccaagaatcacagtggtatttggaaatattttgagatttcgaaataaataattcttccttttaaaacaaataatttttctgagaatcaattaatcgtctaactttaaataaagtaaaaatggataggaattaaactccaatatattgaggcaaacagtctttattttgaaaatcctttttaaaggtttccacaaataactctttaaaggaaagggctaatatttccttcaggaaaatttacaacaatctgttaaccaaactagatcttcaagccccttaccaattcctctccccaattgagtgttttccaaaggtccaatttggaattccttttctttttctttttttcctttctgtaaagggtgagcatacttaggaaattagttaaaattactccattgaatgctctgttgttccttagtattgagggaaggttcaacatatgttaattttgggaatttttttagatactgcaagactatcacatgtagcttagtctcacagcaaggatatccacacaacgtgctattagcaagtaggatgccagccgccacagaccagtattagcctaataggatgaaagatattttgatataaacaaacatgcgagaccacacagtcagtaaacattttatagacaaaaggagaactctaatgacattcatttggcctttggagaggatgcattcggggcatttttcatgttataaaggataattgaatccaaacagtgttcatatgggaacactaaagctctaacagtacataacagagccaagtcagactttttaatatttatatgttcttttagggaaattgttctggttcctgcagatgattaataatacctgctgcatttgcataattcacggtgttaaataattaacaggattataattatattcataattctttatcaattgaagttaataactttggtctgctctagcgcgctatgttattgaactaagatctgtacttcaaaataatgattctagttaatattagcaacacatattacatatctagccctttctttatattccccagtcagctttgacaaattgagtatatggtttaagtcccttaatattcagtgagaagaaatgcattttaaaatctggaaatctgtctgtatttaaacataaatataaataaataaatgaacaaataaataaataaagagctttatatctatactgaggtgtataccatatctatctttatatatatagatatgtgatatttatttttactgcaaagagatagtaaactttttattttagaataggttacaagtaggaaacaaatatacttaaaaaataataaaggtgtacaagatgcaaccatttgcataaaatctaccagtaggtgggtcactcattggccttttgtgaagagatatatttacttcaggacctgaccaattagcctagatgaatattatatttttattacaagtatgtggtgtgattatattattattacaaaattataacaaaaaaagtaatgtagaagtactatatataggaggccttcagcttgtatcccttactcatacttccatcaaaaatgaagcatagaagtatttggagtattgatttattttagtcattcattagctatcatggtcttatccatgtctgaaaatcaaatgcaagatgtactttagtgaagaatgcaataaaaattaatatctgtgcttgtggggtaacaaagttaaaaccaaggcacctttttctactgaaaaggtgtatgaattaaaataacaacaacaaaaaactactatataattcagtctccattcaaataacttataaaatagcttggatgttttcttgaaacatcaatattattaagaagatattccaatacagaaataatttattctgtataaaccgtacttaaaaatgcatggagcctattgtagctgcctaatggttttgtaatatttttgttgaagtggcttaagtacaaaggtttaattgcttattataaaagactaaatattttatatcaatgaattaaatttaaaaaatatctgccattaccacaatagtccagtgggttgcagataatctgagtcaatttaactctcttatcaagagattctgcccagaaaattagcaaccattattatgttctgaaagaacacaaaaggtctataataacattgaaccaattattaaatgtatatttttcttctaagagaagttcgcttctttaaaatttggattacaatatagagaatatcacctaaattattcattttaattaagtcatttcctgattttgtcttagcagatacagtcaattaagaaattatccatattagccttgcatcataagtaagccctaattctgcaaaaattgagtattgtttcatttcctgattctaaatttgcaagccacagaaagtcagatcaaaaataaagattacgagtctaggcttatgatgttaatttagtggatattttaatttaaagatctcaagatgtccctaaaacattctaaaatttttatagctgtaatgttgacaatatctggcatgggatttgaagagattaatggcaagaagagggatttttatgttgtttcatgcaccagagaaaatgaagctaaagggattttgaaaacaagaatgaatcgagagttttgctgttctaagttatgtaaagatatcatggactttatatcccagttcaatgtagaacttcataattttataaatatacatatatacataaatatctaacacatatacatatacttaatataattcatgcatatatatgcatatatacatacatacttcatactgtatatacctactttaatatatagatacacatatgtatgcatacacacatacacacacttaactataatatatatatacatatgcttaatataattcatgcatatatatgcatatatacataccttcatattgcatatacatactttaatatatagatacacacatatgtatgcatacacacagacagacacttatctataatatatatacacctgtctgttcttaccacagatatattcctaggagggtggtagttaaggtactaaagtagggtcatgtaaaatgagattttagtaaattcagaaagactttggaaataatctaccttatttacataaaaaataatatggtgaaatagcaaacaaaatgatcgtatgtctgttaaaccaaatattgtattgacattacttacgaatactaaagtctgaatttttttcttgttttttgctgctgtgttcataatgttatgatacacgatgatctagtacaaggaatttcttgaaagcatatttcaagaaaatagaggtaaagggctctattttatcaatgccattagttactggccacctgctcttatgcgtagggttctgtttaggatatagacatataaataacaaaaatataaatacataaaaaagccatttgccaagtgccaaatggtgcagggagttggaagtcggagattttatcattaccatggctagcataataaaaacagaaagaaaataataaggagatacaaaacagatgggcaagaaaaagaattttcaagaaatgtgaagggaaatagtaaagagaaagactatttaagatgaaaaatgttaatatgagaaaatcaaatgatgaaaaatagcaagtttttttttttagcaagagaatttattcttcatagaacctgtatgacatttatttaagaaacacagaatggtgtcatttcaatttcatgacattccttgtactggtggtacaattttttatacacaggaataaaaaaggaataaaaaagtaaaaggataaataacatagttgagtcctgagaaaacacgggtttgaactgcatgggtccacttacatgccatttttttcaaccagactcagatcaaaaatacagtattcgcagaatgtgaaacctacgtatatagagggccaattttgcctgtgtgcgggttctgcagagttggctgtgaaatgtgagtatgttcagattttggtatacatgagagtactggaaccaataccacgtgcatgctgagggacaactgtatatagttgggagctgtacaaatatataactttactcatgtcttagaacccaaatacagctaaataatacacctgcataacttgaatgtcgttctgggtttttagtactgttggaaagtgtagaccctacactatgcaagtgggttggatgaaggatgacaatgtgcagtcaagtcttgttattcactgtgtttctataaagtcactgtgaacactgaattagtgaatactgaagcattcctcccaggagaaatacaatgatagatttctgggagcctctgctcataacatttttgtgaaccagcaatgtataatcccattttgcctgtttttctgtttaaaaacatcttattgaatatatattattgatccattaacattcaatacacagccaacagcactgtaactcaagcctgaaggaaacttacctaaggaacctattttctttctaaggtacttcacagccttcttaagcttaggaacactagacagaaattcaccatcatgcttggggccatttaaagcagcaaaatcaccaagaaaaagcataaaaatatgaaaaacatagcattaaatacaccgctgaaaggacacttgtttaccgtatgagacctgaagcaagaatgcagagtgttccttttttgatctcagctgggaacatgtgtggtgggtgacttaaatttttcaccactctatgcatacacacaaatggctgtgaaaatgctatgagcattgattttagggatacaaattaaatttagcaagttttgagaactcccaaacacagaatgtgtgaataatgagaaccatctgtacaaagtttcaatcaatatactgcttgattaggccctttttataaagcactatactgtttttagttgcaaatggttaaatcctttcatcccatttggttatggtgtttgtacagaaaactaaattacagacatgtgtattgttgactttctctaattgcccttttgaatgatctgagcagagatcaactgctggaccaaattgtacgtcgagattataatatccaggttttgtcaggcactatggttaagaagtattgtcagttaagatgtactgcaattttaagcaaaagatttttttacatgctcaatctactaagtaaccaggagaagacaaatgtacaagatatttccaagagcattcttgttaccaactgaagaactgtattaataattcagtcctatacagtgctacttagaacttcagtgtcttcttgttaagcgaagtggatgtaaaaaaaaaaaaaatgcaaaggaatgtcataaatgcagtgaatacaaagctgaatttctaaaaagtggagcttgcaaagggactgtaggtgcaatttagtttgaaataggtatgaaatcaaaattttaataacaagtgtcactttgtataccaaaacctgttcatcaatataatcaaacacctagatatccatctgccttgatgatgtttaccatgaatttcataatcccaagtcaaacccagtgtattctactcacatatttgtgagctgtcattaaaggaagctagaacagaatgtagtatgtcatatatatgtgtgtgtgtgtgtgtgtaatgtgagaatgtgcatttatgcaactgagtgtgtgtttgtgtgccttgaggttaagatgtacaagaagtaagcatttggaaagtttgctttgacattacacacgcacacacacacacacacaacccccatttatgtatatatctacacaaacatagacataataattatattaaactctactagtttcctattgctcatataataaattaccatgaacttagtgatttaaatgtacatatattttttatcttttatttttttgagacagagtctcagtcactctgtcgcccaggctggagtgtggtggcacgatctcggctcactgcaacctctatctcccaggcccaagcaattctgatgcctcagcttcccaagtcgctgggactacaggcgtgcatcaccaccccaagcaaatttttgtatttttagtagagatgggcttttaccattttggccaggcaggtctcaaactcctgacctcatgtgatccgtccaccttggcctcgcaaagtgttgggattacatgcgtgatccactgtgcccagcctgttttttttttgtttttttttttttttttatctttcttagagttctggactaaaaccaaggtgtcaatggggcgctgttcattctggagactctaggggagaatccatttcctagcttctagaggctgcctacattccttgattcatggcccctttcctccattttcaaagcaagcagtatagcatcttccagtctacatcacattactctgacacactgcttttcattccaacatctcctttgactccttgaaggatttttttcttccttttttttgatacggagtttcactcttgttgcccaggctggagtgcaatggcgtgatcttggctcactacaacttccgcctcctgggttcaagcaattctcctgcctcagcctcccaagtagctgggattacaggcatgcaccaccatgcctggctaattttgtattttgtagtagagaaggggtttcaccatgttggccaagctggtcttgaactcctgacctcaggtgatccacccgcctcagcctcccaaagtgctgggattacaggcatgagccaccgcacctagccaccttgaaggatctttgtgtgtttgtgcttatttttaattggttccatccacataatccaggataatcttaccatctcaaagtccctaatttaatcaaatctgcaaagtaaactttgcctttttatggtaaaatattaacttaacgggactgggttgttcaaactctgtacattccaaagaaatatctggctcttgactggcttctgggcaataccagatagtttattttaataatgtatggtgcagcttttaggttacactgtatcagtttgaactctggagaggctggagatgactaaagtcagccatgtgagtgttccatgcctactacaaactccaatacaattctagacaccaagacttaggcaacttttcgttggcaatacgatgtgtgtgttgtcacacatcactgttgggataattaaatgctgtccagatgacttcatgaggagaggaaaactggaaggtggcacctggtctttcctgaacccggttgtatgcaacttttttctttgttcacttcagtctttatctttttgttgtaataaactgtaatcatgagtgtaactgcttttaagaattatatgagtcctcctaaggaataattgaacctgagagtagacttgaggactcctaaatttcgccatataaggcaacatattcatagcttcctaagattagaacatgtatgtctttgggggatcattactatgcctacaacagtacataaaatacatgactcttgtgtagaaacttcttcaatttatttgaccagaggactagttttttttttaatattgtcaaaaaagcttggaaacatatgttcctttattgagtcaagattcagttttcttaagagatttttatcaaatgttttgcaatatacctcttgaaaactaccctttcctatatgtagaataaaaattaaaagcacaattaaaagcaaaaacctgtcatattactttccatgtttgttatctagtaaatgactctgtaatcaactatttcctagcaataaacactgaaaaacatactcaactttcatctaagagtacaagaagtaatcaagggaatgggaaaactcaattagctaccagagactgtaaaacatctgttctgaaaaccaaactccaacaattcaatatcaatatctttaaagggataaagattattaatgtaaaattgaactaggaaagatgaaaaacccctgcactaattctcaattatattgggtttaaaggaaaggcaggaataaatcatatatacccatagatggaaataatccaggtatacatacacacacacatacatatatgaaaaatctataagcgttaggttttatattagtatccatgatctattttgagttaatgtttgaataaagtatgaggtgttcaggtcaagtttatttctctgcctatgtgtatccaaataccctagcatcatttgttgaaaatgatagtttccttcattgaattgcttttacacctttgcaaagaatcagtttggcataataatttccttctatttctgggttctgtattttattacattgctccatgtttctgtctcaccaccaatatcacattgtcttcattactgtagctatatactaaggtcttcatgttgagtagagcaattcctcccacattaatcgttttcagtcatgaaatctatagatcgatttgggaagaattgacatctttactatgctgagtcttccaatccatgaatgcaatatatccctgaaattatttaggtcttgatttcttttatcagcattttgtaattttcaggatatatatctcatatatatattgttaatatcttactatttcatttttggggaataatagtaaatgctatttttttcttttttctttttgtgtttttaattctaaatttttaaaaagaaattttaagaatatctaaaatttcaaacgccaagttccttctagcaataatgggaaaaattaacgtttattttgaaggttttttttcttatctgacaagtgatgttgaatctcacttacacaattaaaaagaaacaatacacaataactattacaacaaaatgaacagactttggtactggtttgaagagattaagagcttaaatggtcttaaagagattatattgctcatttgccagaatccatgctttcaaagaaggctgaccacaggcagcctttggaaattaattattaagtgtatattattatatataaaaccttttcatgctgcaaacactacaatatatttctgcaatatcaactaagaattttattctttttctatgcttacattttagaaaataacagtgttttaagtcaacaacatacatggatggtaatatttatgctaaatatggcataacaaccaaataactccttttatttagattcccatatactataaaaacttacaatgcatctacaatttaataaagtatgtgttatcaaacaatactataaaatgaataattgtagtagaaaccaaggttttacccccctctttttgagaattatgctttacatcagtcctccttccattagtctgttagttaaaaagcatattgtcactgcaaaattaattgtaatgtttcctatgcagacatagtgcttaatagagcccactgtctcaatagaaaaggaatctgtctagtttcagccaaatttatttagagtcagataaatttgattaaacataaaacaagtatccatattgaacacctcagttacctaatcctttacagtctagtccattattaacagtattaagatcataagggattaataaagtttctacagaagggaacattttcccttgtctgatttcagtaaaggagcatatagctttgataaaatgaaatcatcatcatcattttctaaaatattctttatgttttatgtttcttgggcttactgtgctgattaagtggagtgataacatattgcactggtaccttatcactccacttaatcaatacagtaatagagctattagtttgaatcctaaaaacttatcattttttggtcaaaatggaccaatatcagcaaattcatatgattcaatctatgtatctatcttaggtatatatggagtggcgtatgaataaacagatatatatatgatttgatgagttaagaataattgggtccagagaaataaagttctctaggcaccactgttctactgaaacaattaatttgttttgatctttatatacatgttcgattagatgatttaaaattttaaagtattaaaagtttaaaaactagttttaaaagtttttttaaaatgatgtttacacatttaattactcagtgtattttttttttttttcgagacagagtcttgctctgtcacccagggtgaagtgcagtgacaccatttccgctcactgcaacccccacctcccaggttcgagtgattctccagcctcagccaccctaaagtgtgccaccatgcccagcaaaattttttttttgtttgtttgtatttcttagtagagacagggtttcaccatgttggccaagctggtctcgaactcctgacctcaaatgatccacctgcctcagcctcccaaagtgctggggttacaggcatgagtcaccttgcctggcctacttcctcagtcttactgagtattttcccctgagaattagataattggccttaccacattccaaaatccagtgattctcttcttaacatgctcatgttatatcccacacaacagtactaatacattattctaattttgcttgcaatgttgctatagtatgaatatttgtgttcctccaaaatttaaatgttgaaagctaatccccaagaggttggtattagggggtgaggtctttaggttgtgattaggttatgagtacagagccttcttgtttgggattagtacccttataaaagagaccctagagagccagctcgcctcttcatcatataaggacacagcaacaaggtaccatctagtagctaggaaacggtctgtcatcaggcacagagtgtgccttcatcttgatcttggacttcccagcctccagaactttgagcaatgaatctctgttgtttctacgccacccagtttattatttttttagtttacgccacccagtttattatttatttttttttatagaagcccaaatggatgaagaatgatagttatttcatagtgaagaatataaaaataatcagcatcactacatccataatcagagaagggaggggtgggataatgaacagagtcataagtataatgtatttagaaatctgggatgaaatcccataaactgaattgagttgagtgccctcctcccccatgatgagtgtgtatgaaaatgcactagagagacagaaatgaaaaatcagggccatcctcaccatgctctgaactcctatgagattcacttgtcatctttcttttaaagatcttatcgtgtattatctgatattacagttacccattatgaggaattatcataagcataacctttatcatcattatcacctttactatcatcgtcatagacagatgtaaatctagcagaatgcaaatataagaaaatgggacctgactcacgtaagaagactttgaaagtttttcttctatcaaaatctgacaagttggcttaaaagggaagatgtgttcataacagtttctttcattttttccatttccatggctaattacattgtaatactccattaaggtaaggatatagcattgtttgtggtgaaatagactctccatgagcaataatttagattgaaaaaggtaaaatatatatatttccacagtttactttatgcaaatggagtgagttgtaatttttggtgagtgggtgagaggtcagttagatgactgtatggaatttaaaaatatccaattacatatatggcagcatcagaagtctctttagcaactctcacaatattgtatagagataaaagcagtcagacagggcaataatcagagccatattactcatttataaaatctcaatgaaaattttctctgaattaagcgttaacaaagaaggatgaggctcaattgtgatggtacgacagacaccaaatgccaatggtacaatacgtttagtacaattgccatacttctatgtgatgttttgtttttatcatgatgttggagcaatagccacagggacagaagtaagcgggttagagggtaaaagttgaatgaatatgtacaggtataccttggagatactgcaggttcagttccagatcaccaaaataaagtgagtcacatgaattattcggtttcccagtgtatataaaagttatatttacattattttgtagcctaagtgtgcaaagcattatgttaaaaaatgtacataccttaacaaaaacataatttattgctaaaaaagctagcaatcatctgagcctttagtgagttgtaatctttttgctagtggaggctcttgcctcaatgtggatggctgctgattgatcagggtggggttgctgaaggtgggagtgactgtgacaactttgtaaaataagacaacaatgaattttgctgcatcaattgactctttctttcacaaaacatttctttgtagcatgtgctgctgtttgatagcactttactcacagtagaacttctttcaaaattggagtcagtcttctcaaattctgccactactttatcagctaagtatgtgtaatattctaaatcctttgttgtcatctcaacaatgttctcagcatcttcaccagaagtaaattttatctcaagaaagcactttctttgctcatccatcagatgcaattcctcatccattcacgctttattatgagattttaggaattcagcaacatcttcaggctccacttctcattttaattctcttgctattgtcaccatatctccagtgacttcttccagtgacaacttgagctccttaaagtcatccatgagggttgaaatcagcttcttctaaactcctgttaaatgtgatattttgacctcctccgatgaatcatgaatgttattaatggcatctagaatggtgaattccttacagaaggctttcaatttcctttgctcatatccatcagaagatttattatttacagcagctataaccttactaaatgtatttcttaaataatgagacataaatgttgaacttactctttgacccatgggctacagaatggatgttatattagcaggtatgaaaacaacatgagtctccttgtacatctccaaatgagctcttggatgaccagctacattattaatgagcagtaatatttttgaaaaaaaaaatatatttttctgagcacaaggtctcaaccccgggcttaaaatattcagtaaatcatgctgtaaacagatgtgctctcatccaggctttattgttacttttatagagcaaaggctaagtctatttagcataattcttaagggccctaggattttcagaatggtaaatgagcattgcttcaacttaaagtcaccagctgcattagactctagcaaaagaatcaccctgtcctttgaagctttgaagccaggcattgacttctcctttctagctatgaaaatcctagatggcatcttcttcaaatagaaggctatttcatctacataaaaaatctgtcatttagtataaccacttttatcaatgatcttagctagaacttctggataacttgctgcagcttctccaactgcacttgctgcctcaccttgcacttttatgtttggaggtggcttctttccttaaacttcataaaccaacttctgctagcttccaacttttcttctgcagcttccttacctctcagccttcgtagaattgaagagagttgggatcttcctctggattagctcttggttaagggaatattgtggctggtttgatctgtctagaccatttaaattttatccatatcagcagtaagactgctttgctttcttttcattcatgtgtgcatgggggtaacacttttaatttccttcaataatttttcctttgcattcacaccttgactaactgtctggtgcaagacgcctagatttcagcctaactcagcttttgacatgccctcctcactaaacataatcatctctagcttttcatttaagatgagacatgtgagactcttcctttcacttgaacacttagagaccactgtggggttgttaactggcttcatttcaatattggtttgtctcagaatagaaaggtccaaggagagggagacagatgtgggggggtgggggtggccggttggtagagcactcagaacacacacaacattgattaagtttgttatttcatatgggcatgactcatgttgcccccaaaaatgacaatagtaacttcaaagatcattgatcatagatcatagatctccatatattctttcagtgtggcttttgtactctaaccagtgtcagcttgttgagggcagaaatcatttctgattaatctttctatgctttcagtgttactaagtgaatgatatttgaactgcaaaaatgtgatgaaatgtgaagatatgacagtgagtcaagaaagaagatacctctgggctttattcatgaaacagcagagatataaatagctttaacatataaattggttgaaagtaagttaaagcaaaatccctatgctaaagagttataatactgtctattgtgatgtaaatatgatagttgaattcataagaaatttttcaatggcaaaatgaggcttggtgatgagattatcatctctaagaaaattcagtcttaagtattactttatgtcgtttttattctccctgaaagtggcctcaaacattctatcttcatcaacattatccttaccacagtgctacttacacattttcccaatttatcaccagctgtcatgcaaaacccagaacaaagccacttagccaaagcacatgtttgactatgaattagacttcttctttttaaaacaaaggtattatttaaacctattgatgctggcttccatcttaagcccataactggcaaccaacaggttagaaaataaaatttcctaattaattgattaggaaattaaccaatttttgttacatctaatactggttggatgtattgttacatccaatactgtttgtgaaaacttgtgctgttggacttgttgtgcttgttgtactcagtcttgcttaatttgtgaaagcatcacacatttaaagtagcccattagctgctttctagctgaggatgagtaggtaaagacaattatttctacatttgtagttggaagtagtcgtagatattatctaattcagtggctttcttcaagatctcagttttctacagctgtgtctatggggttatagggtgaaagttggaataaatggcagttgaatcaaatcgtcctcttgttttcattcaagatgtctacaccttcaattcttcttttctttgctgggctttcatatgagatttttaaaaaaatgtgtcctgtgtatttttaaaatgaaacttgatctattacagtatattctacagttggcaaatatatgaaatattttctatccttcccactgcattcatgccgagcacatacggcatcaaataatggtattttatcccacgagttccaagtagatacagtctcagtctgttatagtactcctggaaactactatcaagcaattgcacatggtgtgatcaacatttgttatcttttctatcactttctatcttctttattctttaatgatttgtaatcgaatgcttccattttttcagaagagaataaaaggcccagaatggtaatgactgttaccaagtcacgatgtagcaaaattggtgtgtcacttctgacagtttctctaactcccaaaccaatgcatattttgataattgccctcattatttcctcaaatatacttccctgtcagaaaaaaatgattatatataaaattaaatgaggaaaactattaataataaaatatcatgttgtcttgggttgccttttaccagaagtagaccctgagcaaattatttgagtgccagcaacttatttcggaggtgatcccaggaagcacagcaaagaagtgagtgagacggagaaaagaacaccagtacagtgtgagtttcatgagcatgtcatcagtgataaaatgaggttcagtaccacttgagaccactaggagaatgatttgtctcacctgagaagcaagaaaggtagggtagttcccacaaactcccatgtgtaatgtgttaagaacaataatcattataattaaataatggattattaactatcacaacattgtagttctattagtctgagccttaatgcatacagatttttgcaaacttcatggaagtttccattttatttgaaattagtttttgattaaaaataatggaacgctccttcaatcaattaaaaatatcagcagatccatctgcttggaaaatgattcttcctgatgctggcttccatcctactggttgacatcattacgttgggttaagcagtgacatgggtaattgttcttaaaatgtgatcaattctcttattctcccacacacttttgacctgcatttattctctatctttgttatattaaagattgtcaatgttttcccttaatttgacagcacaaatgaatatcaacatggcactattgcctcaaaatggaaaaggcaaaaaagcaatcatgaatcacatgtttctttaatatacagttacagattttgagttcatttccacttctgattgtggttatatcttccaccttccctttcctttcatgccgttttatattaaaggtcaatatgttcatttattaattatgcaacaagtgtcatgtttacaatgtttgtaaatgtagtcacagtatttgattttcttaatataataaaatttatcctctgctttggctaatataagcccacaaatgatcatttcattttctaataaattaaaagtataatgtatacaattggattctgtcaggcttgatgtgtcttttaaacacagcacattaaattccactatgtataaaaaggactgtatataatgtcaatagagaataaacagaattgctacaaaaagcatcgacataaatgattaaatatacatagctcttggcatgtggcttcctgttacacagaattgtgctttttaataatggataatttcaaaaccaatttgctggatacttaatgcatctttgagattttccttccacagagaagatttaggagattataaagtaattaatttgttcacttctttattaattttctaatatcacaaagctatgcattagaaggaagtaggtattaacatctcatatcatttgatacatccactgaattcctacgctctttgcagcctcaaggcacctgtgtgctggcagactttgcagagtactactgaagttgaggctgtaaaccaatcacgcatttgctctgctttcatattgctggcattatacatctgctattcgccaaccccaaatccttcagtatgtagttctcattttctgatgaaaattcagtggaaaaaatggaagtagatatttgcttttaatttcaggtatactttacaataaccatgctgcacagtacaattgggtgattggtgaactccatcattttctattagtgatgaaacaagacaaatgaagaaccacatttttgctttgtgttactttaccaatatgcctgaatccatgtaccttataaacgaaactgtcaatttactcttctattattttaggtgatgattccattaaattaagacctctggggaggtcatgtgtaagtcacaaaggaaatagagcctttaaaataccatgtagggtaactatcataccatcataactaaatatcccgacttttacggtgtgaaatagacaaaaatggtaacttgggtcaacgcatttccctaaactgaatgaggaggaatcttgacaatagtactgctcgtgtactatggttagtaatattagagggaagaaggatgcaatggaaatgatgtcaccttaggactcaaacaaatgtcttactggctgtgtaactcattactactttaagttaaacttgagtagctccctccagaagagctaagcaaagggtaaaaaaaaaaaaagaatagagaattcatggccctcaggcactaatagtttatgaataaatcaataacctgaaaagtacatcacagcaaaataagtggtgaaacaagtattaggaagattctatgcacaggggtgcatgattcagccaaaagtaaagaagaggcactagctacactattttggaggattataaagcatgtaccaagtaaatatatgtgaataagaattgtttatgactgtgggatggagtcaacatttccaaaggcacatgaaaaggaagtgtgttacagtcagagaactgtttgtatggctagggtgaggcattcacatggtggatataagattagactgagcacatggcagggaaattgttgtaaagtaccttctcttcatgcaagttatttgaattataatctataaataatataaagccacctgtggactttaagcagtggaataacttattaagttttgtctttgagagagataagcctagcagccttgtgaagggtaaactggagagaagcaagaaggaaggtacattaggaagctatcagtgtattcgaagtcagatatggggatctaaactaaggtggtgactgtcaggagatatggaggggggatggcagagctaaaagaaatttaggatacaaataggagaaattagttacatggctctctataaagaggaaataagacttcctaccttgcttacctcatatggttcctatgtgaataaattaaacttgaaagtattttgttaattttaaagctttatacatttaaggaattaagattatcaagtacttatgaattaaatgtacttgttttattgacattcctatttgttcacatacagtgaaacaactataaacatttgcttcacttactccttaagaggaaagtagcatgctaggtaactcatctggatttaaatttctaagtggaagtactattgagtatctactctgcatgaagctagggaagtgtggcaaggggactctagccaaggactagaagatagagagactgagagcaagttgtttctcaggcatctgtggaatgcttctccaatgaacaagaaagagaaagaaatatttggaactaaaatatgcatgagaagtaatcaaccttggaataggttgctaaaaagaattaaaagattcttataataagttcagtctctaaatgcaagaaaagtttagtaataatctggtctctggatattaactcacctaatccgtatttaggttgcacatgaataagagttccgtatttagaaaattgtatttattcaatacaatgaataaaatcaaggccaacgaagtgacttctctaattaccgttttggaaaaaaaagatacagaaaatgaattatttaatgatattggaaaaagaggttatccctaagacctatgtatggcagaagaactaaaggcaggtagtgacccaaatctgtatcactaactcaatttccttccaagcaggtacagaagtagatcatggaaggagtgaaatgcatagaatcttataaagatctggttctgattagagctgtttcacaagtagcttaatctcacttaggctcagcttctagatctataaactaggcataataaaacattttggcgggggttgttccaaagattagctaaaataacgcatgaactgcacctagcatgttaaaaataaatagtaaatattaatgtactagtaattatgttttgtaaactaaattttatctcactaaaagaaagtattgtaaaatttatgttgttcttcatccactatagaaaatgaaaactttttgaattagaaccaaatttggaatgggaacatccaagtaataagaataaatgtgaaaagaaactgaatataataataaagttatgaaagaggaaaaataaaatctgatgccgaaaagaacatataggttttttttgttttgttttgttttcctttgttttttgagacagaatctcactctgtcacccaggttggagtgcactggcacgatcttgactcattgcaacctcagcctcctgggttcaagcgattcttctgcctcagcctcccgagtagctgggactacaggcacgtgagcccacctaatttttgtgtttttagtagagatggggtttcaccatattggccaggctggtctcgaactcctgacctcatgatacacccacctcgacctcccaaaatgctgggattacaggcatgagccaccacgcccggcccatacaggtttaaatattgcatggccatgctatacaacagtttgttagctgaagatatttttgttcacaaaatcaatgagattaatcacgcatcactctatacttgctattaaaattactatgtcacgcattttgtggccttccaaaagagacaaggagtttgagtcacagtattagacaagactaaagaccctacatggtttactagaaaaaaaccctttacttcagtgtcaggagacttttattacgtatctggccttactactaactggaagaaacttaaaagaaatgacaatttctctataagtcacactttcctcatctttcaaactaagatatgggactaaatattctttaatggtctccgggttttgaaattctaagttcctataaaagatatctgtctagatgtttgcaacacatacaataaatgtagggaccatataaaaatgtaaagatctcatacctataaaaaccaaaattgtaaatcaatagaaaaatgagcatgagattagaaaagtgcacttttatatatttgtgttatagttcagtaaaacattttaaaaatcaagttgatagaattactttctttaatctacaaagggaaattactaatgaaagttgggaggaaatgttatccttactatagataacatccacatgagcaataaacacaaaaaatggttctcaaattaattagtcactagaaaaaaatggaaatgagaaacacaatgagatactatagtataacagccagaaaggctgaaattaaagactaataatgctaagcattgacatgtccagaacttctataaagtaatgatggttctttgtttacctaccttgaaaaactacgtggcattttcaactaaagatgagtatttcactattctatgacctaataattctacttcttggcacataacagaactacatgcatatgtgcagtaaatttgcaagaatattcaaagtggaattatttttaagagttcacaaatggaatcaatttaaatgttcatccagagtagatggaataagtaaattataggacatttatatgatggcatactacacaacactgaaaattatgggaccacaactacaagaaacaaattagatagatctcacaaacagaatgttgagatttaggagccagaaacaaaagagtacagctgtatggcttcaagtacatacatttcaggaactgtctgtcctaatcaatggtgtgttagatgtcagtattccacttacctctgggagagtattgactaggaagtggtaagacaaagtttttggatgctggtaatattcttttcttgccttgagtaattactggggtgtgcccaatctgtgaaaattcatgaagctggacacctattgatttgtgaacttttatatattcgtgttatagttcagtaaaatgttttaaaaatcaaggaggacagaaatactttccttaatctataaagggaaattactaatgaatgttgggaggaatttttctttgcctttagcctatatatctaagttacttcagcgagtcagagatataaatagatatatagataaatatatacatatatgtgtatatatgcatatctatatatgtcagaagaagggagagagaaagaggagagagagagacttttttcgataattaaattctttagaaaatgtactgcttgagagagaatgactttctggatgattcgattcttcagaaaatatcttgtttacctgtctctttttaatttcctaggaggagttgggtgtgaggctggagatcaattaaattggaagatgttgaaattggataaaaccttacggattatctaacacaatttcttattgttacaggtttatttggcaatagatctattctatctgagatgttatcctttcagccctcctttgtaacctctgaggtctgattctgtgattaatttaactttatacatgagtgaaacattttcaggtagcttctaattaaagagtgttagacattgagataaaatatgacaaggtctctaaagatagcataggaaaaagtttccagggatagacgtacataaactaccaatgggaggtaactgttttcaaatcctcctgaaagtttgcatggtcatgctcatgctagctttaatcatatttaatatcattgtatgcaactggcttttagaccagcctagacattttccttctaggtttgattccagtgaagatgagcaacaggtggaaggcatgctcctttttatttcaagtgacacttcaaatatgtcgctttaccctttactttgaattactatttttcactggatttgctttctttctgttcagttatcattttgctctttgatggacttgccagtttttccacatcactcacactaggaactccggaaacctctagctcagtcctaagtcagctttactgtctgggttcacagttgctgttgctctctgcttagctattcactgtaaatatttttctcttctcatccacataaaccacgttcgtctctaaattcctcagggactgtatcttagtcatcttgctctagcacagagcctggcagttagaatttatcaataaatatttgttggatgaatgaaaagcagcagaaacaacctttcatttcagttggtgggctctaatcctgtctggatgacctaatggagaaatagactctgtttcctgccactgtggccaccaaaaccagcccatgaatgggtcagcagccaaagggagaggaacctgagattcctactcactaatgtgtccatcacatgcaggcttttacttaatctcctttttacacttgtcatagaacataaatgagtcccacatctcccctaaaacccatacaatttcaggttagcattagtgtcactttcaataatccagcttattgttgctggaccgaacaattctacttatagcatgtataaaagaaatctgtactagtaaaaacagactatgatggtccttatcacattttatcctgggagtgttataatcagttgtaacaatgtcatgaccagagctgaatgatgctgataagtttattttcccttagctctttgtattcataaccctgtcttcaaattgcaacataatgtcaatatttcttctggaaatttgataagcaccatccatttaccttcaggtgtacattgacagcaattaatctctgcgtaccacctacgtttccagttgtcatcctgtacctcctctataaacgtttgctcaaaagaacatctcagttttacttttgtctagacaatatttttacccatttgcttatttactgcagtgcactttaggctgtaaccccaaagctcaagaaaataagttttttggaagccagtcatgttaggcatataatttatatgtttataatttaagtcatcttttcaaaagtagtatatatattgaatatttaaagtattcttgttttattcagatgtcacattttatattgcaattagtatctataggtcaaaatgtatggagttataaaaaaggttttctttaaaaaatttgctttccaacactatcaaaggagacactgaaacattacagctaacttgagttttttcatttaatttaaagatagtgtgaacaggtactgaagacactgtcttacattttactaatatctatatagagtggattaaatttgtgaaaacatatatctgcacagagtctataaatttctcaaggtcagaaaataaaccataaaaagatttaattcctctaaagctttaagcatgctaacatttgttaacttgatcttataaaatgacatttgagatgtgtttatcttccaacctaaaatattaatttttattgatcaggttataagtttttgcttacttgcaataactttattattttttctgttgaccctaacatataacaaatgaagacatgtgcagatataacatgttaagaagataaataaaacatcaacactcatgttaacactgcaaatacacatgagagctttatactaagacggccatctcctccctctgacttatattttcctgaaggacatttacatagcataaatattttaaagacttttggctatttgatgacaccttgaacatatactttgaatctaagggaaaggagagtcatatttatctcctttctaaaacaattcaaatgtgatgtgtccctatttgctaagctgaaagtaagatgaagtcaaataaatggaaaatcaaatatttttaaacttctaggagctttttgtttgcttttttgttattttaataagagaaacaaagtaaaacatgtaaaaacacaaactctcacccagcatcctcttacgaaatacccaattttcaaataagcagtactatttgctctatttattactggtctttaagagaaatagacctaaaaaagaacatcttggaaggctagtgtactttcataattccctgagaagctcagtgattatgagtaatgtgaaccagagttcaatattcttacccttggaatcaggaaaaagaaagtcctttaaaagatcaagatctttgatagcagtaacaagaactaaatttgccaggggtagagccgtcctcttaccaatttcaggcaagaagcaatcttttcttgagtagcgaaaggcaagccaactaaagaaaaaatctgtgtgacttcaattacataaaattgactagatggttaaaaaacaatactttcacagaattttttctttctgtaaaactttacttgtatgttggttcttatttcattcagagatatattaagagcaaatgaaattgtgaaattattttcaaatacacaaaaaaagctcccccacgacaactttttctcaattgcctcttttgcctttcctcagttttatagtcttcagtgggtctccctcattgctccatattcctaagccaacaggaagaatttctttcagacccttaagccttgtgtctgttaccatagagacaggcatcacaaagtagctgctcaggaacatcctcatggaaatacaataagaatcctatgggttttacaggaatttccagcgctaccagtgagcagaaattatatctttccctagaaaaaaaatgtggggattttagttgcacattatggaactatggagattgtaatatttggtggtaaattcagaatccctcagctttatgcttagaatttgattatagtttctcctatgacatgaaaaaaaatcccttctcatatccctatgttcaggaaaatataaataactcattgctaattcttaaatttagcatgtcttatcaatcatttactaaaacccttaactgttcttttatagtgcagtgcatttgttttatcttgatcccttctagaacatatttgatcaagaacacactcataatgttataaaagtaagtctctaaaactgcaattccaaagctgctgagagagtctataaacccacgaagagagaagagggtagctgcaagaagaaaattccactcactttaccttgttttccattgactttcaccctttctgtaagtctactgaaatcatacactaacggaaaagcagcaataaaaataacagaatcctaccaaataggtaaattcagcaagattaatggagtcaaactaggcagatattatatataagtcaatgattgcagagacttcaattttttatggaaacattaaataaacattcctcaacaagtaaattatctcaatagactaacagccaaatgaaaccatctttatctgttaggctgcatatttgaactacttttccaagtctctagtacttaagtagtatgggtggttacaatttctgtttatggtatagaactgttatttaactgttacattgcttgtttagatacttgagtcaataagcaaaaaacaaaatttctttatagtctagagatgaggtgagcaaacttttcctatcgagggccagatagtaaatattcctgctttgtggcccacatggtctctgtcataagtactcaactgtgttttagcatgaaaggagtcctatatagcatataaacaaataaatgggtgtggctgtcttccaaataaactatagactcttaaattgaaattttatataatctcatgtgtcagaaatattcttgaaatgaaacaattcagaaacgtgaaaaccattttaaatgactggtcaaacagtaatagatgtgacaatgtggactatcatttactgacccctagcctggatgatgcgagtggagtagtagagaccctcagagaaataaatgtctaaaaaaaagaacatgtttttaaaagaaatgattggactcacagattcttagttaaaaattatctcagacatcttcttcaatttccatttagtgcagaaactccattcttagcactgaacactttaggaataaggagtgcagtgtctcacaaagtaatcaattctctgctcacaacattaactggaagaatacttttccattgctaccaaagaggtgcaagtgagtctaaaccctcttctgcattatagcacatcgaatatttgaaatcagcttaattttctctacttttttccttcaagtattcttcaacttttcacttttctagtactttccatgcccctcaaatgttatagtttgtaggaccttttagcattcagacacttttcactgaacatacccccaaatgttaaggttcctcttagatcatggtgtccttctaaaatatgtatatattaccacatataatatatacatataccatacctatcatatatatacacacacacaccattatatcatatatatccttctaaaattcgttctcatttttttcatttcctttttcaggatacatgtctaacaatattactttgtttcattgtattttgatgtcatatgaattatgactgataataatgatgaccaacaaaatcagtaagatttattcaattaattattactaagctttaactctctcatgtcctgtacttgccagattgattttatgaaccttagcttaggatgttatacttattcctattacaattattctctttgacctcaccacagtttttaggtggtcataatcctttggtaccctaatagttcaatgtatttgttctgcttcccagatagacaggctatctggatcgtccttcagtttttggacattaatatttcacaggccaagtaggttcaagaacagagacataaggcacattacagaagattaggttcaagtcagatggaaccaattttatagaactatgctatagtcctgtgaaaggccctcttcctggtttactgtgattcattaattgatacatcacaggcagggtcatttagccagctgatttattgaccagactcttatgtcaaacagcaaatatttctccattttcaccatatgggcatcataaaaatctttaccaaagtccatgctataatcaagataactagccatattacatacttttcagataacattggagaatcacagcatatattatctttgcactctttctaaaccatctcaccttcttcaggaattgtcagttactcccagtgaagaaaaaatattgcatatttttctggaaaaatatttccagttttaagtaattatttactctccacaatctaattatggactttccttcctatttttcactttagtttattaactccaggaccaactaaaatattgtcgtggctttctctttttaaacagttctgacttttttttttttccaaagcgtgtgtgtgtgtgtgtgtgtgtgtatgcacatgcttaagtggtttgtttttatttgctttttccttcttaaaagatggattatatgagaatgggaggataataggatggagcaagcttctcaggcaaaacatttcaaagcatatttcttaaccgatagtgtcttcccctgctcatctttctgaagagcaacacctgagaggcagctactctagctcatgtgggaaatttcacttgacagtcttatcacaaaaagagaaataagggagatttttttacttaaaaaataatgatgctcaataaaatttttacctaaaagagataaataattgttttagaatataaatgccttagagaaaacaatctgagtttgagagaattggggaaaactcacatagatttataaaagtcactaattctggatttaaaaatatattaaaatgtttgcagtctatttcattgtgtcccacttctctttcacaccttctatttttatgcatttctccttcatcgttttttcttccttaaagcacttcagaagacacaggattaagcaattgggatttgaagacttcacgtggtctcatcactctgcaggctgaccctgttttagagcaagaaatattggcagacatttccagctcttacaatgcatttatcaataagggtttgcctgctcttcaggtgcgtggcatatagactttacgatttcattaataatcaacagctggtgccacctagcgtctgtccaatccattcatcagtgggaccaaatacagagcactttctaaccgcaaatgaagcaagcctaaactataaactaaaaaatacaaaaacacagtttggggattccagtggctgatttaaagtacgctatcttcattgaaaaagaaaaaccttcttttaaaagtaactatggtaacaagagagtgaggctagaaggaagctcacattttttcgaaggagacaattcacaaaaggagagtcctactaaagatgcagtgtaaaagagtttttacagtcttgaatggtcacttaaaacggttataaaaagttgaaaagtaacattggccaaagagggctgtattttaaacaacagtatagacagagctgaattttctcaaccaaccacaaaataaccctgtagcatttggatgcaaaattctgtcagtctttgagcttcccaaagattaaccaagttctgtaacacactatacaaaagcatctacagtacttaaaagtattaaacggaaataatcagagtgcctgaaccacattataaaaaaaaattctttgctgctaaaatgatacatctagaaaactattttctttcctgctgtatatatgaattatgaatgatattcaaccacggtaatgtatgcttcaaggttaaaaagtagtcatccaaatccttgactatttttcaaaacagaagttagcaattattttggagaaatcctagtgtaattagcccaccacttgctaattaatttactgatatttaaatacatgttgtttttaactcaccctttctaagaggaatacgtaattgaaaaccatggactaacattcagaaaaaaagttacataacagccaatagtgttccttaaccagactgactgggatattacaattactacagaaaaggcacagcacatacgagtagcactgtgtacactgaaaggtcatattagatgtacatatatgatagtctattaacttggatgatttagctcctcaggctatggaggagactgggtagagagccgaaagattctgtattacatagacagttaataatcaggcttttcacacttaggaaaatctatttctatattatttaacatctgttttaaacaatcacttgttaaatgtttgaatgttttatttgcttgttaccctagtggtgataaagattatttcaatatgttcagtctgattacagtcactgacagatccccatgacagcatgtgaagataggttatagaaacgatgcatagtttatacaaaaagcataaattgctcccctttctccaaaaactttatttttggagccaaatactgtccatgctcatgctccatttgcttaaaagtacttataattataatccactgattgtaggggaaagaaatattgcaaaacagagaaagggttctaaaaatcgtacgcaggcaagaaagaatgtaagacaaaactcattaaagggcaaaataaataaataaataaataaataaataaataaatgctcacattttcaataatttatcacttctgtcatttttcattaacagccttcaaagccctatctgaaacaagctgatacagagaaattaagagcagtaatcaagcgagaaatcatagaccagctgggtcgacatcaacttggcaaaacgtgaatacagttcaatagctgaaacagatgctagagttgttgaaaaaccctgcaggagatattgatatattttcttcatataatgcagaatgactgaataaatgtcaaaagctagaaattgatgaggagaaatgactgacagccaaactccttataaaatagaaaccaagtataacaattttcaacctatccaaacattctgtacattctcatttctctcactgtctgaatatgccaatacatcaatcagttcttgcaactaaattgcatataactaatctggggtagatttccccgaagatttttttccccctgtcatcatctacctgaagaaacctagactcctgaacaatactttattctaaaatcttctaacactgatttctatcccagaagtgttttcctgaggttggaggcaagcacaccccctccccaaaatctaacgcagcacaaggcaattttaaaatccattctgtaaaagcaacactgtttgcagagtttgaagagctcggcaacaaaccccagctaccaacagctgcttgttcaaacatatgctttgtcatggccagcttctaattgtatttgtaatgatgtaatagctttaataatcctaccttccatgccagctgtttttcctgtcactccatcatgccaataagttggctgctgtaacaaatcaagatagtgcaaaacagcatctttctcctgattctgtcatcttcctgaaagcattctattactgccgactgctgggaaccagaaagtctatttgaattccaacagctcccctttcgcatgattcaagttaggttaggtgggcatgcctaacatgattctttcagtcatttattatgcagctgctacaacgtcggtgtggtaaccactctgactatctgatacgtcagtcgaacaaaacctatacctcggagcaaacacatgagccagagcagcgtttgcatttaacg
